(12) United States Patent
Swanson et al.

(10) Patent No.: US 11,732,022 B2
(45) Date of Patent: Aug. 22, 2023

(54) PD-L2 VARIANT IMMUNOMODULATORY PROTEINS AND USES THEREOF

(71) Applicant: Alpine Immune Sciences, Inc., Seattle, WA (US)

(72) Inventors: Ryan Swanson, Seattle, WA (US); Michael Kornacker, Seattle, WA (US); Mark F. Maurer, Seattle, WA (US); Dan Ardourel, Seattle, WA (US); Daniel William Demonte, Seattle, WA (US); Joseph L. Kuijper, Kenmore, WA (US)

(73) Assignee: Alpine Immune Sciences, Inc., Seattle, WA (US)

(*) Notice: Subject to any disclaimer, the term of this patent is extended or adjusted under 35 U.S.C. 154(b) by 584 days.

(21) Appl. No.: 16/493,751

(22) PCT Filed: Mar. 13, 2018

(86) PCT No.: PCT/US2018/022267
§ 371 (c)(1),
(2) Date: Sep. 12, 2019

(87) PCT Pub. No.: WO2018/170023
PCT Pub. Date: Sep. 20, 2018

(65) Prior Publication Data
US 2021/0130437 A1    May 6, 2021

Related U.S. Application Data

(60) Provisional application No. 62/537,928, filed on Jul. 27, 2017, provisional application No. 62/475,156, filed on Mar. 22, 2017, provisional application No. 62/472,572, filed on Mar. 16, 2017.

(51) Int. Cl.
*C07K 14/705* (2006.01)
*A61K 38/00* (2006.01)

(52) U.S. Cl.
CPC ........ *C07K 14/70532* (2013.01); *A61K 38/00* (2013.01); *C07K 2319/02* (2013.01); *C07K 2319/03* (2013.01); *C07K 2319/30* (2013.01); *C07K 2319/74* (2013.01)

(58) Field of Classification Search
None
See application file for complete search history.

(56) References Cited

U.S. PATENT DOCUMENTS

| | | |
|---|---|---|
| 5,168,062 A | 12/1992 | Stinski |
| 5,208,020 A | 5/1993 | Chari et al. |
| 5,385,839 A | 1/1995 | Stinski |
| 5,443,964 A | 8/1995 | Pickup et al. |
| 5,457,035 A | 10/1995 | Baum et al. |
| 5,500,362 A | 3/1996 | Robinson et al. |
| 5,624,821 A | 4/1997 | Winter et al. |
| 5,648,260 A | 7/1997 | Winter et al. |
| 5,698,530 A | 12/1997 | Schlom et al. |
| 5,716,613 A | 2/1998 | Guber et al. |
| 5,716,826 A | 2/1998 | Guber et al. |
| 5,731,168 A | 3/1998 | Carter et al. |
| 5,767,071 A | 6/1998 | Palladino et al. |
| 5,780,426 A | 7/1998 | Palladino et al. |
| 5,821,337 A | 10/1998 | Carter et al. |
| 5,851,529 A | 12/1998 | Guber et al. |
| 5,891,432 A | 4/1999 | Hoo |
| 5,998,205 A | 12/1999 | Hallenbeck et al. |
| 6,143,290 A | 11/2000 | Zhang et al. |
| 6,194,551 B1 | 2/2001 | Idusogie et al. |
| 6,365,619 B1 | 4/2002 | Shi |
| 6,428,968 B1 | 8/2002 | Molnar-Kimber et al. |
| 6,596,535 B1 | 7/2003 | Carter |
| 6,630,575 B2 | 10/2003 | Coyle et al. |
| 6,632,670 B1 | 10/2003 | Wadsworth et al. |
| 6,635,472 B1 | 10/2003 | Lauermann |
| 6,635,750 B1 | 10/2003 | Coyle et al. |
| 6,653,103 B2 | 11/2003 | Peterson et al. |
| 6,689,871 B1 | 2/2004 | Wolfe et al. |
| 6,723,316 B2 | 4/2004 | Laquerre et al. |
| 6,737,056 B1 | 5/2004 | Presta |
| 6,855,317 B2 | 2/2005 | Koelle et al. |
| 6,887,471 B1 | 5/2005 | Linsley et al. |
| 6,897,045 B2 | 5/2005 | Engelhardt et al. |
| 6,936,257 B1 | 8/2005 | Bennett |
| 6,998,252 B1 | 2/2006 | Moss et al. |
| 7,001,765 B2 | 2/2006 | Maass et al. |

(Continued)

FOREIGN PATENT DOCUMENTS

| | | |
|---|---|---|
| EP | 0757099 | 2/1997 |
| EP | 1385466 | 2/2004 |

(Continued)

OTHER PUBLICATIONS

Jones, Pharmacogenomics Journal (2001) 1:126-134. (Year: 2001).*
Tosatto et al., Current Pharmaceutical Design (2006), 12:2067-2086. (Year: 2006).*
U.S. Appl. No. 16/321,000, filed Jan. 25, 2019, by Swanson et al. (Copy not provided). (Copy not submitted herewith pursuant to the waiver of 37 C.F.R. § 1.98(a)(2)(iii) issued by the Office on Sep. 21, 2004).
U.S. Appl. No. 16/493,752, filed Sep. 12, 2019, by Swanson et al. (Copy not provided). (Copy not submitted herewith pursuant to the waiver of 37 C.F.R. § 1.98(a)(2)(iii) issued by the Office on Sep. 21, 2004).
U.S. Appl. No. 16/343,709, filed Apr. 19, 2019, by Swanson et al. (Copy not provided). (Copy not submitted herewith pursuant to the waiver of 37 C.F.R. § 1.98(a)(2)(iii) issued by the Office on Sep. 21, 2004).

(Continued)

*Primary Examiner* — Meera Natarajan
*Assistant Examiner* — Cheom-Gil Cheong
(74) *Attorney, Agent, or Firm* — Morrison & Foerster LLP

(57) ABSTRACT

Provided herein are immunomodulatory proteins comprising variant PD-L2 and nucleic acids encoding such proteins. The immunomodulatory proteins provide therapeutic utility for a variety of immunological and oncological conditions. Compositions and methods for making and using such proteins are provided.

9 Claims, 17 Drawing Sheets

Specification includes a Sequence Listing.

(56) References Cited

U.S. PATENT DOCUMENTS

| | | |
|---|---|---|
| 7,033,826 B2 | 4/2006 | Perricaudet et al. |
| 7,094,875 B2 | 8/2006 | Punnonen et al. |
| 7,125,717 B2 | 10/2006 | Carter |
| 7,153,510 B1 | 12/2006 | Rose |
| 7,172,893 B2 | 2/2007 | Rabinowitz et al. |
| 7,238,526 B2 | 7/2007 | Wilson et al. |
| 7,241,447 B1 | 7/2007 | Engelhardt et al. |
| 7,247,615 B2 | 7/2007 | Schlom et al. |
| 7,332,581 B2 | 2/2008 | Presta |
| 7,368,116 B2 | 5/2008 | Schlom et al. |
| 7,371,826 B2 | 5/2008 | Presta |
| 7,378,087 B2 | 5/2008 | Jefferies et al. |
| 7,537,924 B2 | 5/2009 | Coffin |
| 7,550,296 B2 | 6/2009 | Hermiston et al. |
| 7,560,540 B2 | 7/2009 | Pardoll et al. |
| 7,588,767 B2 | 9/2009 | Szalay et al. |
| 7,588,771 B2 | 9/2009 | Szalay et al. |
| 7,662,398 B2 | 2/2010 | Szalay et al. |
| 7,662,627 B2 | 2/2010 | Johnson et al. |
| 7,709,214 B2 | 5/2010 | Freeman et al. |
| 7,731,952 B2 | 6/2010 | Mohr et al. |
| 7,731,974 B2 | 6/2010 | Bell et al. |
| 7,754,221 B2 | 7/2010 | Szalay et al. |
| 7,811,814 B2 | 10/2010 | Bohn et al. |
| 7,897,146 B2 | 3/2011 | Brown et al. |
| 7,906,111 B2 | 3/2011 | Wilson et al. |
| 7,927,585 B2 | 4/2011 | Snyder |
| 7,943,374 B2 | 5/2011 | Hildinger |
| 7,968,340 B2 | 6/2011 | Hallek et al. |
| 8,007,780 B2 | 8/2011 | Arbetman et al. |
| 8,053,414 B2 | 11/2011 | Pardoll et al. |
| 8,053,558 B2 | 11/2011 | Pardoll et al. |
| 8,445,447 B2 | 5/2013 | Chen |
| 8,911,726 B2 | 12/2014 | Takahashi et al. |
| 8,956,619 B2 | 2/2015 | Ostrand-Rosenberg |
| 9,103,831 B2 | 8/2015 | O'Sullivan et al. |
| 9,327,014 B2 | 5/2016 | Gurney et al. |
| 9,453,227 B2 | 9/2016 | Diamond et al. |
| 11,078,282 B2 | 8/2021 | Swanson et al. |
| 11,096,988 B2 | 8/2021 | Swanson et al. |
| 11,117,948 B2 | 9/2021 | Swanson et al. |
| 11,117,949 B2 | 9/2021 | Swanson et al. |
| 11,117,950 B2 | 9/2021 | Swanson et al. |
| 11,230,588 B2 | 1/2022 | Swanson et al. |
| 11,319,359 B2 | 5/2022 | Swanson et al. |
| 2002/0009454 A1 | 1/2002 | Boone et al. |
| 2002/0168714 A1 | 11/2002 | Barbas et al. |
| 2003/0138881 A1 | 7/2003 | Punnonen et al. |
| 2004/0009604 A1 | 1/2004 | Zhang et al. |
| 2004/0063094 A1 | 4/2004 | Coffin et al. |
| 2004/0072283 A1 | 4/2004 | Seed et al. |
| 2004/0146488 A1 | 7/2004 | Hu et al. |
| 2005/0014934 A1 | 1/2005 | Hinton et al. |
| 2005/0220818 A1 | 10/2005 | Lorence |
| 2005/0260601 A1 | 11/2005 | Whitt et al. |
| 2006/0024298 A1 | 2/2006 | Lazar et al. |
| 2006/0039894 A1 | 2/2006 | Mohr et al. |
| 2007/0098743 A1 | 5/2007 | Bell et al. |
| 2007/0110720 A1 | 5/2007 | Brown et al. |
| 2007/0202572 A1 | 8/2007 | Szalay et al. |
| 2007/0212727 A1 | 9/2007 | Szalay et al. |
| 2009/0010889 A1 | 1/2009 | Brown et al. |
| 2009/0053244 A1 | 2/2009 | Chen et al. |
| 2009/0098529 A1 | 4/2009 | Chen et al. |
| 2009/0117034 A1 | 5/2009 | Chen et al. |
| 2009/0136917 A1 | 5/2009 | Szalay et al. |
| 2009/0155287 A1 | 6/2009 | Chen et al. |
| 2009/0162288 A1 | 6/2009 | Chen et al. |
| 2009/0215147 A1 | 8/2009 | Zhang et al. |
| 2009/0274728 A1 | 11/2009 | Brown et al. |
| 2009/0285860 A1 | 11/2009 | Martuza et al. |
| 2010/0062016 A1 | 3/2010 | Szalay et al. |
| 2010/0092515 A1 | 4/2010 | Conner et al. |
| 2010/0113567 A1 | 5/2010 | Barber |
| 2010/0172877 A1 | 7/2010 | van den Pol et al. |
| 2010/0178276 A1 | 7/2010 | Sadelain et al. |
| 2010/0178684 A1 | 7/2010 | Woo et al. |
| 2010/0196325 A1 | 8/2010 | Szalay et al. |
| 2010/0233078 A1 | 9/2010 | Szalay et al. |
| 2010/0261660 A1 | 10/2010 | Punnonen et al. |
| 2011/0064650 A1 | 3/2011 | Szalay |
| 2011/0064763 A1 | 3/2011 | Allen et al. |
| 2011/0158948 A1 | 6/2011 | Brown et al. |
| 2011/0159023 A1 | 6/2011 | Langermann |
| 2011/0177032 A1 | 7/2011 | Martuza |
| 2011/0195068 A1 | 8/2011 | Langermann et al. |
| 2011/0212530 A1 | 9/2011 | Baltimore et al. |
| 2011/0293705 A1 | 12/2011 | Irvine et al. |
| 2013/0017199 A1 | 1/2013 | Langermann |
| 2013/0149305 A1 | 6/2013 | Ostrand-Rosenberg |
| 2013/0287748 A1 | 10/2013 | June et al. |
| 2014/0011370 A1 | 1/2014 | Camphausen |
| 2014/0050708 A1 | 2/2014 | Powell et al. |
| 2014/0099309 A1 | 4/2014 | Powell et al. |
| 2014/0154216 A1 | 6/2014 | Coffin |
| 2014/0186380 A1 | 7/2014 | Gurney |
| 2014/0186401 A1 | 7/2014 | Diamond et al. |
| 2014/0227237 A1 | 8/2014 | June et al. |
| 2014/0322129 A1 | 10/2014 | Leong et al. |
| 2014/0348832 A1 | 11/2014 | Zhu et al. |
| 2015/0232532 A1 | 8/2015 | Ostrand-Rosenberg |
| 2015/0359909 A1 | 12/2015 | O'Sullivan et al. |
| 2016/0017041 A1 | 1/2016 | Violette et al. |
| 2016/0339066 A1 | 11/2016 | Szalay et al. |
| 2016/0347849 A1 | 12/2016 | Cai et al. |
| 2016/0376346 A1 | 12/2016 | Camphausen |
| 2017/0028040 A1 | 2/2017 | Lan et al. |
| 2018/0118805 A1 | 5/2018 | Bernett et al. |
| 2018/0244749 A1 | 8/2018 | Swanson et al. |
| 2018/0256644 A1 | 9/2018 | Swanson et al. |
| 2019/0135922 A1 | 5/2019 | Swanson et al. |
| 2019/0175654 A1 | 6/2019 | Swanson et al. |
| 2020/0040059 A1 | 2/2020 | Swanson et al. |
| 2021/0130436 A1 | 5/2021 | Swanson et al. |
| 2021/0155668 A1 | 5/2021 | Swanson et al. |
| 2021/0155669 A1 | 5/2021 | Swanson et al. |
| 2021/0163571 A1 | 6/2021 | Swanson et al. |
| 2021/0171603 A1 | 6/2021 | Swanson et al. |
| 2021/0188942 A1 | 6/2021 | Swanson et al. |
| 2021/0253668 A1 | 8/2021 | Swanson et al. |
| 2021/0347897 A1 | 11/2021 | Swanson et al. |
| 2022/0242930 A1 | 8/2022 | Swanson et al. |

FOREIGN PATENT DOCUMENTS

| | | |
|---|---|---|
| EP | 1391213 | 2/2004 |
| EP | 1520175 | 4/2005 |
| EP | 1606411 | 12/2005 |
| EP | 1870459 | 12/2007 |
| EP | 3020816 | 5/2016 |
| WO | WO-1993/010151 | 5/1993 |
| WO | WO-1994/011026 | 5/1994 |
| WO | WO-1994/029351 | 12/1994 |
| WO | WO-1998/050431 | 11/1998 |
| WO | WO-1999/002711 | 1/1999 |
| WO | WO-1999/038955 | 8/1999 |
| WO | WO-1999/051642 | 10/1999 |
| WO | WO-2000/042072 | 7/2000 |
| WO | WO-2001/030843 | 5/2001 |
| WO | WO-2002/000717 | 1/2002 |
| WO | WO-2004/029197 | 4/2004 |
| WO | WO-2004/056312 | 7/2004 |
| WO | WO-2005/063816 | 7/2005 |
| WO | WO-2005/100402 | 10/2005 |
| WO | WO-2006/019447 | 2/2006 |
| WO | WO-2006/029879 | 3/2006 |
| WO | WO-2007/052029 | 5/2007 |
| WO | WO-2008/011636 | 1/2008 |
| WO | WO-2008/092117 | 7/2008 |
| WO | WO-2008/155134 | 12/2008 |
| WO | WO-2009/029342 | 3/2009 |
| WO | WO-2009/067800 | 6/2009 |
| WO | WO-2009/076524 | 6/2009 |
| WO | WO-2010/027827 | 3/2010 |

(56) References Cited

FOREIGN PATENT DOCUMENTS

| | | |
|---|---|---|
| WO | WO-2010/027828 | 3/2010 |
| WO | WO-2011/020024 | 2/2011 |
| WO | WO-2011/056983 | 5/2011 |
| WO | WO-2011/113019 | 9/2011 |
| WO | WO-2011/133886 | 10/2011 |
| WO | WO-2012/079000 | 6/2012 |
| WO | WO-2012/125850 | 9/2012 |
| WO | WO-2012/141984 | 10/2012 |
| WO | WO-2012/149364 | 11/2012 |
| WO | WO-2013/003761 | 1/2013 |
| WO | WO-2013/130683 | 9/2013 |
| WO | WO-2013/149167 | 10/2013 |
| WO | WO-2013/169338 | 11/2013 |
| WO | WO-2014/089169 | 6/2014 |
| WO | WO-2014/198002 | 12/2014 |
| WO | WO-2014/207063 | 12/2014 |
| WO | WO-2015/107026 | 7/2015 |
| WO | WO 2015/120363 | 8/2015 |
| WO | WO-2016/011083 | 1/2016 |
| WO | WO 2016/191643 | 1/2016 |
| WO | WO-2016/022994 | 2/2016 |
| WO | WO 2016/034678 | 3/2016 |
| WO | WO-2016/073704 | 5/2016 |
| WO | WO 2016/118577 | 7/2016 |
| WO | WO 2016/154684 | 10/2016 |
| WO | WO-2016/168771 | 10/2016 |
| WO | WO 2017/019846 | 2/2017 |
| WO | WO-2017/029389 | 2/2017 |
| WO | WO-2017/048878 | 3/2017 |
| WO | WO 2017/079117 | 5/2017 |
| WO | WO-2017/181148 | 10/2017 |
| WO | WO-2017/181152 | 10/2017 |
| WO | WO-2017/201131 | 11/2017 |
| WO | WO-2018/022945 | 2/2018 |
| WO | WO-2018/022946 | 2/2018 |
| WO | WO-2018/075978 | 4/2018 |
| WO | WO-2018/170021 | 9/2018 |
| WO | WO-2018/170023 | 9/2018 |
| WO | WO-2018/170026 | 9/2018 |
| WO | WO-2019/136179 | 7/2019 |

OTHER PUBLICATIONS

U.S. Appl. No. 16/493,750, filed Sep. 12, 2019, by Swanson et al. (Copy not provided). (Copy not submitted herewith pursuant to the waiver of 37 C.F.R. § 1.98(a)(2)(iii) issued by the Office on Sep. 21, 2004).

"Database accession No. A9UFX3," version 38. Retrieved from Uniprot, http://www.uniprot.org/uniprot/A9UFX3.txt?. Retrieved on Jan. 18, 2018.

"Database accession No. ADM18706." Retrieved from Ibis, http://ibis/exam/dbfetch.jsp?id=GSP:ADM18706. Retrieved on Oct. 10, 2017.

"Database accession No. ADM18913." Retrieved from Ibis, http://ibis/exam/dbfetch.jsp?id=GSP:ADM18913. Retrieved on Oct. 10, 2017.

"Database accession No. B3TFD9," version 63. Retrieved from Uniprot, http://www.uniprot.org/uniprot/B3TFD9.txt?version=63. Retrieved on Dec. 10, 2017.

"Database accession No. BCD07227." Retrieved from Ibis, http://ibis/exam/dbfetch.jsp?id=GSP:BCD07227. Retrieved on Oct. 10, 2017.

"Database accession No. BCD07228." Retrieved from Ibis, http://ibis/exam/dbfetch.jsp?id=GSP:BCD07228. Retrieved on Oct. 10, 2017.

"Database accession No. BD020821," Retrieved from Geneseq, https://www.ebi.ac.uk/ena/data/view/BD020821. Retrieved on May 16, 2018.

"Database accession No. BD020825," Retrieved from Geneseq, https://www.ebi.ac.uk/ena/data/view/BD020825. Retrieved on May 16, 2018.

"Database accession No. F1PWL4," version 43. Retrieved from Uniprot, http://www.uniprot.org/uniprot/F1PWL4.txt?version=43. Retrieved on Dec. 10, 2017.

"Database accession No. F7DZ76," version 32. Retrieved from Uniprot, http://www.uniprot.org/uniprot/F7DZ76. Retrieved on Jun. 6, 2018.

"Database accession No. G1SUI3," version 36. Retrieved from Uniprot, http://www.uniprot.org/uniprot/G1SUI3.txt. Retrieved on Jun. 6, 2018.

"Database accession No. P32506," version 99. Retrieved from Uniprot, http://www.uniprot.org/uniprot/P32506.txt?. Retrieved on Jan. 18, 2018.

Baban et al., "Bacteria as vectors for gene therapy of cancer," Bioeng Bugs. (2010) 1(6):385-394.

Benson et al., "GenBank," Nucleic Acids Res (2013) 41 (Database issue):D36-D42.

Brown et al., "Structure-based mutagenesis of the human immunodeficiency virus type 1 DNA attachment site: effects on integration and cDNA synthesis," J Virol. (1999) 73(11):9011-9020.

Bruggemann et al., "Comparison of the effector functions of human immunoglobulins using a matched set of chimeric antibodies," J Exp Med. (1987) 166(5):1351-1361.

Buchschacher et al., "Human immunodeficiency virus vectors for inducible expression of foreign genes," J Virol. (1992) 66(5):2731-2739.

Busch et al., "Dimers, leucine zippers and DNA-binding domains," Trends Genet. (1990) 6(2): 36-40.

Chakrabarti et al., "A mutant B7-1/Ig fusion protein that selectively binds to CTLA-4 ameliorates anti-tumor DNA vaccination and counters regulatory T cell activity", Vaccine, Elsevier, Amsterdam, NL, vol. 23, No. 37, Aug. 31, 2005 pp. 4553-4564.

Chang et al., "The discovery of small molecule carbamates as potent dual alpha(4)beta(1)/alpha(4)beta(7) integrin antagonists," Bioorg Med Chem Lett. Jan. 21, 2002;12(2):159-63.

Chari et al., "Immunoconjugates containing novel maytansinoids: promising anticancer drugs," Cancer Res. (1992) 52(1):127-131.

Clynes et al., "Fc receptors are required in passive and active immunity to melanoma," Proc Natl Acad Sci U S A. (1998) 95(2):652-656.

Colby et al., "Engineering antibody affinity by yeast surface display," Methods Enzymol. 2004;388:348-58.

Colcher et al., "Use of monoclonal antibodies as radiopharmaceuticals for the localization of human carcinoma xenografts in athymic mice," Methods Enzymol. (1986); 121: 802-16.

Condomines et al., "Tumor-Targeted Human T Cells Expressing CD28-Based Chimeric Antigen Receptors Circumvent CTLA-4 Inhibition," PLoS One (2015) 10(6):e0130518.

Cornetta et al., "No retroviremia or pathology in long-term follow-up of monkeys exposed to a murine amphotropic retrovirus," Hum Gene Ther. (1991) Fall;2(3):215-9.

Cragg et al., "Antibody specificity controls in vivo effector mechanisms of anti-CD20 Yeagents," Blood. (2004) 103(7):2738-2743.

Cragg et al., "Complement-mediated lysis by anti-CD20 mAb correlates with segregation into lipid rafts," Blood. (2003) 101(3):1045-1052.

David et al., "Protein iodination with solid state lactoperoxidase," Biochemistry. Feb. 26, 1974;13(5):1014-21.

Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.

Dull et al., "A Third-Generation Lentivirus Vector with a Conditional Packaging System," J Virology (1998) 72(11): 8463-8471.

Duncan et al., "The binding site for C1q on IgG," Nature. Apr. 21, 1988;332(6166):738-40.

Engelman et al., "Multiple effects of mutations in human immunodeficiency virus type 1 integrase on viral replication," J Virol. 1995 69(5):2729-2736.

Evans et al., "Generation of Novel Immuno-Oncology Biologies via Directed Evolution of Variant IgSF Domains," Poster Presentation for Immune Checkpoint Inhibitors, Boston, MA (Mar. 14-16, 2017) 1 page.

(56) References Cited

OTHER PUBLICATIONS

Evans et al., "Novel immunomodulatory proteins generated via directed evolution of variant IgSF domains," Abstract for AAI Immunology 2017, Washington D.C. (May 12-16, 2017) 1 page.
Evans et al., "Novel immunomodulatory proteins generated via directed evolution of variant IgSF domains," Poster for AAI Immunology 2017, Washington D.C. (May 12-16, 2017) 1 page.
Evans et al., "Therapeutic T Cell Activation Using Engineered Variant IgSF Domains," Poster presented at Society for Immunotherapy of Cancer, National Harbor, MD, (Nov. 9-13, 2016) 1 page.
Fargeas et al., "Identification of residues in the V domain of CD80 (B7-1) implicated in functional interaction with CD28 and CTLA4", Journal of Exoerimental Medicine, vol. 182, No. 3. Sep. 1, 1995 pp. 667-675.
Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-57.
Garcia-Aragoncillo et al., "Design of virotherapy for effective tumor treatment," Curr Opin Mol Ther. Aug. 2010;12(4):403-11.
Gazzano-Santoro et al., "A non-radioactive complement-dependent cytotoxicity assay for anti-CD20 monoclonal antibody," J Immunol Methods. Mar. 28, 1997;202(2):163-71.
Gentz et al., "Parallel association of Fos and Jun leucine zippers juxtaposes DNA binding domains," Science. Mar. 31, 1989;243(4899):1695-9.
Gherardi et al., "Recombinant poxviruses as mucosal vaccine vectors," J Gen Virol. (2005) 86(Pt 11):2925-2936.
Guerra et al., "Host response to the attenuated poxvirus vector NYVAC: upregulation of apoptotic genes and NF-kappaB-responsive genes in infected HeLa cells," J Virol. Jan. 2006;80(2):985-98.
Hallden et al., "Oncolytic virotherapy with modified adenoviruses and novel therapeutic targets," Expert Opin Ther Targets. Oct. 2012;16(10):945-58.
Harris et al., "CD80 costimulation is essential for the induction of airway eosinophilia," J Exp Med. Jan. 6, 1997;185(1):177-82.
Hellstrom et al., "Antitumor effects of L6, an IgG2a antibody that reacts with most human carcinomas," Proc Natl Acad Sci U S A. (1986) 83(18):7059-7063.
Hellstrom et al., "Strong antitumor activities of IgG3 antibodies to a human melanoma-associated ganglioside," Proc Natl Acad Sci U S A. (1985) 82(5):1499-1502.
Hinman et al., "Preparation and characterization of monoclonal antibody conjugates of the calicheamicins: a novel and potent family of antitumor antibiotics," Cancer Res. (1993) 53(14):3336-3342.
Hu et al., "Yaba-like disease virus: an alternative replicating poxvirus vector for cancer gene therapy," J Virol. (2001) 75(21):10300-10308.
Hunter et al., "Preparation of iodine-131 labelled human growth hormone of high specific activity," Nature. May 5, 1962;194:495-6.
Idusogie et al., "Mapping of the C1q binding site on rituxan, a chimeric antibody with a human igG1 Fc," J Immunol. (2000) 164(8):4178-4184.
Infante et al., "Overview Clinical and Pharmacodynamic (PD) Results of a Phase 1 Trial with AMP-224 (B7-DC Fc) that Binds to the PD-1 Receptor," Journal of Clinical Oncology (2013) 31(15_suppl):3044-3044.
Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.
Ke et al., "Rapid and efficient site-directed mutagenesis by single-tube 'megaprimer' PCR method," Nucleic Acids Research (1997) 25(16):3371-3372.
Khalil et al., "The future of cancer treatment: immunomodulation, CARs and combination immunotherapy," Nat Rev Clin Oncol. (2016) 13(5):273-90.
Khan et al., "Characterization of the New World monkey homologues of human poliovirus receptor CD155," J Virol. Jul. 2008;82(14):7167-79.
Kirn et al., "Targeted and armed oncolytic poxviruses: a novel multi-mechanistic therapeutic class for cancer," Nat Rev Cancer. Jan. 2009;9(1):64-71.
Koike et al., "A second gene for the African green monkey poliovirus receptor that has NO putative N-glycosylation site in the functional N-terminal immunoglobulin-like domain," J Virol. Dec. 1992;66(12):7059-66.
Kojima et al., "Fusion Protein of Mutant B7-DC and Fc Enhances the Antitumor Immune Effect of GM-CSF-secreting Whole-cell Vaccine," J Immunother. (2014) 37(3):147-54.
Kolberg, "Gene-transfer virus contaminant linked to monkey's cancer," J NIH Res. (1992) 4:43-44.
Labrijn et al., "Therapeutic IgG4 antibodies engage in Fab-arm exchange with endogenous human IgG4 in vivo," Nat Biotechnol. Aug. 2009;27(8):767-71.
Larsen et al., "Rational development of LEA29Y (belatacept), a high-affinity variant of CTLA4-Ig with potent immunosuppressive properties," Am J Transplant. Mar. 2005;5(3):443-53.
Leabman et al., "Effects of altered FcγR binding on antibody pharmacokinetics in cynomolgus monkeys," MAbs. (2013) 5(6):896-903.
Levin et al., "Novel Immunomodulatory Proteins Generated via Directed Evolution of Variant IgSF Domains," Abstract for Keystone Symposia: Immune Regulation in Autoimmunity and Cancer, Whistler, British Columbia, Canada (Mar. 26-30, 2017), 1 page.
Levin et al., "Novel Immunomodulatory Proteins Generated via Directed Evolution of Variant IgSF Domains," Poster presentation for Keystone Symposia: Immune Regulation in Autoimmunity and Cancer, Whistler, British Columbia, Canada (Mar. 26-30, 2017), 1 page.
Levin et al., "Novel Transmembrane Immunomodulatory Proteins (TIPs) Generated via Directed Evolution of IgSF Domains Enhance CAR-T Cell Activity," Abstract for ASH 2017.
Levin et al., "Novel Variant Ig Domain (vIgD) Proteins Generated via Directed Evolution of IgSF Domains Have Therapeutic Efficacy in Animal Models of Graft Versus Host Disease," Abstract for ASH 2017.
Lewis et al., "Novel immunomodulatory proteins generated via directed evolution of variant IgSF domains," Abstract for Poster Presentation at the Federation of Clinical Immunology Societies Meeting, Chicago IL (Jun. 14, 2017) 2 pages.
Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.
Li et al., "Structure of the human activating natural cytotoxicity receptor NKp30 bound to its tumor cell ligand B7—H6," J Exp Med (2011) 208(4): 703-714.
Lin et al., "Specific and dual antagonists of alpha(4)beta(1) and alpha(4)beta(7) integrins," Bioorg Med Chem Lett. Jan. 21, 2002;12(2):133-6.
Lin et al., "The PD-1/PD-L1 complex resembles the antigen-binding Fv domains of antibodies and T cell receptors," Proc Natl Acad Sci U S A. (2008) 105(8):3011-3016.
Lindblad-Toh et al., "A high-resolution map of human evolutionary constraint using 29 mammals," Nature (2011) 478(7370):476-482.
Lindblad-Toh et al., "Genome sequence, comparative analysis and haplotype structure of the domestic dog," Nature. Dec. 8, 2005;438(7069):803-19.
Linsley et al., "Human B7-1 (CD80) and B7-2 (CD86) bind with similar avidities but distinct kinetics to CD28 and CTLA-4 receptors," Immunity. Dec. 1994;1(9):793-801.
Lipson et al., "Antagonists of PD-1 and PD-L1 in Cancer Treatment," Semin Oncol. Aug. 2015;42(4):587-600.
Liu et al., "Crystal structure of cell adhesion molecule nectin-2/CD112 and its binding to immune receptor DNAM-1/CD226," J Immunol. Jun. 1, 2012;188(11):5511-20.
Liu et al., "Eradication of large colon tumor xenografts by targeted delivery of maytansinoids," Proc Natl Acad Sci U S A. (1996) 93(16):8618-8623.

(56) References Cited

OTHER PUBLICATIONS

Lode et al., "Targeted therapy with a novel enediyene antibiotic calicheamicin theta(I) 1 effectively suppresses growth and dissemination of liver metastases in a syngeneic model of murine neuroblastoma," Cancer Res. (1998) 58(14):2925-2928.
Mandler et al., "Immunoconjugates of geldanamycin and anti-HER2 monoclonal antibodies: antiproliferative activity on human breast carcinoma cell lines," J Natl Cancer Inst. Oct. 4, 2000;92(19):1573-81.
Mandler et al., "Modifications in synthesis strategy improve the yield and efficacy of geldanamycin-herceptin immunoconjugates," Bioconjug Chem. Jul.-Aug. 2002;13(4):786-91.
Mandler et al., "Synthesis and evaluation of antiproliferative activity of a geldanamycin-Herceptin immunoconjugate," Bioorg Med Chem Lett. May 15. 2000;10(10):1025-8.
Maurer et al., "Novel B7-Family-Based Immuno-Oncology Biologies Derived via Directed Evolution of IgSF Domains," Poster Presentation made at The Society for Immunotherapy of Cancer (SITC), National Harbor, MD (Nov. 8-12, 2017). 1 page.
Maurer et al., "Novel B7-Family-Based Immuno-Oncology Biologies Derived via Directed Evolution of IgSF Domains," Abstract for Society for Immunotherapy of Cancer's (SITC) 32nd Annual Meeting, National Harbor, MD (Nov. 8-12, 2017, 1 page.
Mayr et al., "Passage history, properties, and applicability of the attenuated vaccinia virus strain MVA," Infection. (1975);3:6-14. (English translation of abstract provided).
McLoughlin et al., "TNFerade, an adenovector carrying the transgene for human tumor necrosis factor alpha, for patients with advanced solid tumors: surgical experience and long-term follow-up," Ann Surg Oncol. Oct. 2005;12(10):825-30.
McWilliams et al., "Mutations in the 5' end of the human immunodeficiency virus type 1 polypurine tract affect RNase H cleavage specificity and virus titer," J Virol. (2003) 77(20):11150-11157.
Merchant et al., "An efficient route to human bispecific IgG," Nat Biotechnol. Jul. 1998;16(7):677-81.
Mercier et al., "A chimeric adenovirus vector encoding reovirus attachment protein sigma1 targets cells expressing junctional adhesion molecule 1," Proc Natl Acad Sci U S A. (2004) 101(16):6188-6193.
Miller et al., "Construction and properties of retrovirus packaging cells based on gibbon ape leukemia virus," J Virol. (1991) 65(5):2220-2224.
Miller et al., "Construction and screening of antigen targeted immune yeast surface display antibody libraries," Curr Protoc Cytom. Jul. 2008;Chapter 4:Unit4.7.
Miller et al., "Gene transfer by retrovirus vectors occurs only in cells that are actively replicating at the time of infection," Mol Cell Biol. (1990) 10(8):4239-4242.
Miller, "Protein-protein recognition and the association of immunoglobulin constant domains," J Mol Biol. Dec. 20, 1990;216(4):965-73.
Milone et al., "Chimeric receptors containing CD137 signal transduction domains mediate enhanced survival of T cells and increased antileukemic efficacy in vivo," Mol Ther. (2009) 17(8):1453-64.
Miyoshi et al. "Development of a self-inactivating lentivirus vector," J Virol. (1998) 72(10):8150-8157.
Molin et al., "Two novel adenovirus vector systems permitting regulated protein expression in gene transfer experiments," J Virol. (1998) 72(10):8358-8361.
Morton et al., "Differential effects of CTLA-4 substitutions on the binding of human CD80 (B7-1) and CD86 (B7-2)," J Immunol. (1996) 156(3):1047-1054.
Narumi et al., "Adenovirus vector-mediated perforin expression driven by a glucocorticoid-inducible promoter inhibits tumor growth in vivo," Am J Respir Cell Mol Biol. (1998) 19(6):936-941.
Nightingale et al., "Transient gene expression by nonintegrating lentiviral vectors," Mol Ther. (2006) 13(6):1121-1132.
Nishimori et al., "Identification and characterization of bovine programmed death-ligand 2," Microbiol Immunol. (2014) 58(7):388-97.

Nygren, "Conjugation of horseradish peroxidase to Fab fragments with different homobifunctional and heterobifunctional cross-linking reagents. A comparative study," J Histochem Cytochem. May 1982;30(5):407-12.
Pain et al., "Preparation of protein A-peroxidase monoconjugate using a heterobifunctional reagent, and its use in enzyme immunoassays," J Immunol Methods. (1981);40(2):219-30.
Patyar et al., "Bacteria in cancer therapy: a novel experimental strategy," J Biomed Sci. (2010) 17(1):21.
Peach et al., "Both extracellular immunoglobin-like domains of CD80 contain residues critical for binding T cell surface receptors CTLA-4 and CD28," J Biol Chem. (1995) 270(36):21181-7.
Penix et al., "Two essential regulatory elements in the human interferon gamma promoter confer activation specific expression in T cells," J Exp Med. (1993) 178(5):1483-1496.
Peper et al., "An impedance-based cytotoxicity assay for real-time and label-free assessment of T-cell-mediated killing of adherent cells," J Immunol Methods. Mar. 2014;405:192-8.
Pérez De La Lastra et al., "Epitope mapping of 10 monoclonal antibodies against the pig analogue of human membrane cofactor protein (MCP)," Immunology. (1999) 96(4):663-70.
Petkova et al., "Enhanced half-life of genetically engineered human IgG1 antibodies in a humanized FcRn mouse model: potential application in humorally mediated autoimmune disease," Int Immunol. (2006) 18(12):1759-1769.
Pfeifer et al., "Gene therapy: promises and problems," Annu Rev Genomics Hum Genet. (2001);2:177-211.
Philpott et al., "Use of nonintegrating lentiviral vectors for gene therapy," Hum Gene Ther. Jun. 2007;18(6):483-9.
Powell et al., "Sequence and structural determinants required for priming of plus-strand DNA synthesis by the human immunodeficiency virus type 1 polypurine tract," J Virol. (1996) 70(8):5288-5296.
Ravetch et al., "Fc receptors," Annu Rev Immunol. (1991);9:457-92.
Ridgway et al., "'Knobs-into-holes'engineering of antibody CH3 domains for heavy chain heterodimerization," Protein Eng. Jul. 1996;9(7):617-21.
Rosenberg et al., "Use of tumor-infiltrating lymphocytes and interleukin-2 in the immunotherapy of patients with metastatic melanoma. A preliminary report," N Engl J Med. (1988) 319(25):1676-1680.
Rowland et al., "Drug localisation and growth inhibition studies of vindesine-monoclonal anti-CEA conjugates in a human tumour xenograft," Cancer Immunol Immunother. (1986);21(3):183-7.
Seow et al., "Biological gene delivery vehicles: beyond viral vectors," Mol Ther. (2009) 17(5):767-777.
Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem. (2001) 276(9):6591-6604.
Sommerfelt et al., "Receptor interference groups of 20 retroviruses plating on human cells," Virology. May 1990;176(1):58-69.
Srinivasan et al., "Immunomodulatory peptides from IgSF proteins: a review," Curr Protein Pept Sci. (2005) 6(2):185-96.
Strohl, "Optimization of Fc-mediated effector functions of monoclonal antibodies," Curr Opin Biotechnol. Dec. 2009;20(6):685-91.
Tangney et al., "The use of Listeria monocytogenes as a DNA delivery vector for cancer gene therapy," Bioeng Bugs. (2010) 1(4):284-287.
Tareen et al., "Design of a novel integration-deficient lentivector technology that incorporates genetic and posttranslational elements to target human dendritic cells," Mol Ther. (2014) 22(3):575-587.
Tartaglia et al., "Highly attenuated poxvirus vectors," AIDS Res Hum Retroviruses. (1992) 8(8):1445-1447.
Terawaki et al., "Specific and high-affinity binding of tetramerized PD-L1 extracellular domain to PD-1-expressing cells: possible application to enhance T cell function," Int Immunol (2007) 19(7):881-890.
Thompson et al., "cis-acting sequences required for inducible interleukin-2 enhancer function bind a novel Ets-related protein, Elf-1," Mol Cell Biol. (1992) 12(3):1043-1053.

(56) References Cited

OTHER PUBLICATIONS

Todd et al., "Transcription of the interleukin 4 gene is regulated by multiple promoter elements," J Exp Med. (1993) 177(6):1663-1674.
Vafa et al., "An engineered Fc variant of an IgG eliminates all immune effector functions via structural perturbations," Methods. (2014) 65(1):114-26.
Van Pijkeren et al., "A novel Listeria monocytogenes-based DNA delivery system for cancer gene therapy," Hum Gene Ther. Apr. 2010;21(4):405-16.
Vitetta et al., "Redesigning nature's poisons to create anti-tumor reagents," Science. Nov. 20, 1987;238(4830):1098-104.
Wade et al., "Genome sequence, comparative analysis, and population genetics of the domestic horse," Science. Nov. 6, 2009;326(5954):865-7.
Wang et al., "In vitro characterization of the anti-PD-1 antibody nivolumab, BMS-936558, and in vivo toxicology in non-human primates," Cancer Immunol Res. (2014) 2(9):846-856.
Wang et al., "Molecular cloning, characterization and three-dimensional modeling of porcine nectin-2/CD112," Vet Immunol Immunopathol. 2009 132(2-4):257-63.
Wang et al., "Molecular modeling and functional mapping of B7—H1 and B7-DC uncouple costimulatory function from PD-1 interaction," J Exp Med. 2003 197(9):1083-91.
Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.
Wu et al., "IL-24 modulates IFN-gamma expression in patients with tuberculosis," Immunol Lett. (2008) 117(1):57-62.
Zhao et al., "A Bispecific Protein Capable of Engaging CTLA-4 and MHCII Protects Non-Obese Diabetic Mice from Autoimmune Diabetes," PLoS One (2013) 8(5):e63530-e63530.
Zhao et al., "Structural Design of Engineered Costimulation Determines Tumor Rejection Kinetics and Persistence of CAR T Cells," Cancer Cell (2015) 28(4):415-428.
Zhao et al., "TIGIT overexpression diminishes the function of CD4 T cells and ameliorates the severity of rheumatoid arthritis in mouse models," Exp Cell Res. Jan. 1, 2016;340(1):132-8.
Zimin et al., "A new rhesus macaque assembly and annotation for next-generation sequencing analyses," Biol Direct. Oct. 14, 2014;9(1):20.
Zufferey et al., "Self-inactivating lentivirus vector for safe and efficient in vivo gene delivery," J Virol. (1998) 72(12):9873-9880.
Behr et al., "Trastuzumab and breast cancer," N Engl J Med.(2001) 345:995-996.
Biasini et al., "SWISS-MODEL: modelling protein tertiary and quaternary structure using evolutionary information," Nucleic Acids Res (2014) 42:W252-258.
Boder et al.. "Optimal screening of surface-displayed polypeptide libraries," Biotechnol Prog. (1998) 14:55-62.
Brandt et al., The B7 family member B7—H6 is a tumor cell ligand for the activating natural killer cell receptor NKp30 in humans. J Exp Med. (2009) 206:1495-1503.
Burmeister et al., ICOS controls the pool size of effector-memory and regulatory T cells. J lmmunol.(2008) 180:774-82.
Carter et al., "Cytotoxic T-lymphocyte antigen-4 and programmed death-1 function as negative regulators of lymphocyte activation," Immunol Res (2003) 28:49-59.
Carter et al., "Humanization of an anti-p185HER2 antibody for human cancer therapy," Proc Natl Acad Sci USA (1992) 89:4285-4289.
Chao et al., "Isolating and engineering human antibodies using yeast surface display," Nat Protoc. (2006) 1:755-768.
Chattopadhyay et al., "Structural basis of inducible costimulator ligand costimulatory function: determination of the cell surface oligomeric state and functional mapping of the receptor binding site of the protein," J Immunol. Sep. 15, 2006;177(6):3920-9.
Derer et al., Complement in antibody-based tumor therapy. Crit Rev Immunol. (2014) 34:199-214.
Ellis et al., "Interactions of CD80 and CD86 with CD28 and CTLA4," J Immunol (1996) 156:2700-2709.

Esensten et al., CD28 costimulation: from mechanism to therapy. Immunity. (2016) 44:973-988.
Freeman et al., "Engagement of the PD-1 immunoinhibitory receptor by a novel B7 family member leads to negative regulation of lymphocyte activation," J Exp Med (2000) 192(7):1027-1034.
Gregoire-Gauthier et al., "Use of immunoglobulins in the prevention of GvHD in a xenogeneic NOD/SCID/gammac-mouse model," Bone Marrow Transplant (2012) 47:439-450.
Haile et al., "Tumor Cell Programmed Death Ligand 1-Mediated T Cell Suppression ins overcome by coexpression of CD80," J Immunol (2011) 186(12):6822-6829.
Halaby et al., "The immunoglobulin superfamily: an insight on its tissular, species, and functional diversity," J Mol Evol (1998) 46:89-400.
Jenkins et al., "CD28 delivers a costimulatory signal involved in antigen-specific IL-2 production by human T cells," J Immunol. (1991) 147:2461-6.
Kremer et al., "Treatment of rheumatoid arthritis by selective inhibition of T-cell activation with fusion protein CTLA4Ig," N Engl J Med (2003) 349(20):1907-1915.
Linderholm et al (Bio Process International, 2014, 12(10): 20-27.
Maurer et al., "ALPN-202 combines checkpoint inhibition with conditional T cell costimulation to overcome T cell suppression by M2c macrophages and improve the durability of engineered T cell anti-tumor responses," AACR Annual Meeting 2020 Cancer Res (2020) 80(16suppl):Abstract nr LB-085.
Mease et al., "Efficacy and safety of abatacept, a T-cell modulator, in a randomised, double-blind, placebo-controlled, phase III study in psoriatic arthritis," Ann Rheum Dis. (2017) 76:1550-8.
Ochoa et al., "Antibody-dependent cell cytotoxicity: immunotherapy strategies enhancing effector NK cells," Immunol Cell Biol. (2017) 95:347-55.
Parslow et al., "Antibody-drug conjugates for cancer therapy," Biomedicines. (2016) 4:E32.
Rennert et al., "The IgV domain of human B7-2 (CD86) is sufficient to co-stimulate T Tymphocytes and induce cytokine secretion," International Immunology (1997) 9(6):805-813.
Ruperto et al., Abatacept in children with juvenile idiopathic arthritis: a randomised, double-blind, placebo-controlled withdrawal trial. Lancet. (2008) 372:383-391.
Sadelain, M. et al., "The basic principles of chimeric antigen receptor design." Cancer Discov., Apr. 2013, vol. 3, No. 4, pp. 388-398.
Sarmay et al (Mol Immunol, 1992, 29(5): Abstract).
Scholten et al., "Promiscuous behavior of HPV16E6 specific T cell receptor beta chains hampers functional expression in TCR transgenic T cells, which can be restored in part by genetic modification," Cell Oncol. (2010) 32:43-56.
Srivastava et al., "Engineering CAR-T cells: Design Concepts," Trends in Immunology (2015) 36(8):494-502.
Swanson et al., "CD80 vIgD-Fc proteins combine checkpoint antagonism and costimulatory signaling for elicit potent anti-tumor immunity in vitro and in vivo" American Association for Cancer Research (AACR). Chicago, IL, Apr. 14-18, 2018, Abstract 4550, 1 page, published Jul. 2018.
Topalian et al., "Safety, activity, and immune correlates of anti-PD-1 antibody in cancer," N engl J Med (2012) 366:2443-2454.
Van Der Merwe et al.. "CD80 (B7-1) binds both CD28 and CTLA-4 with a low affinity and very fast kinetics," J exp Med (1997) 185:393-403.
Vincenti et al., "Costimulation blockade with belatacept in renal transplantation," N Engl J Med. (2005) 353:770-81.
Weber et al., "ICOS maintains the T follicular helper cell phenotype by down-regulating Kruppel-like factor 2," J Exp Med. (2015) 212:217-33.
Wekerle et al., "Belatacept: from rational design to clinical application," Transplant International (2012) 25:139-150.
Wolchok et al., Development of ipilimumab: a novel immunotherapeutic approach for the treatment of advanced melanoma. Ann N Y Acad Sci. (2013) 1291:1-13.
Wu et al., "CTLA-4-B7 Interaction Is Sufficient to Costimulate T Cell Clonal Expansion," J. Exp. Med. (1997) 185(7):1327-1335.

(56) References Cited

OTHER PUBLICATIONS

Yao et al., "B7-h2 is a costimulatory ligand for CD28 in human," Immunity. (2011) 34(5):729-40.
Yoshinaga et al., cell co-stimulation through B7RP-1 and ICOS. Nature. (1999) 402:827-832.
Yu et al., "The role of B7-CD28 co-stimulation in tumor rejection," Int Imm (1998) 10(6):791-797.
Zhang et al., "An NKp30-Based Chimeric Anitgen Receptor Promotes! Cell Effector Functions and Antitumor Efficacy In Vivo," J Immunol (2012) 189:2290-2299.
Doty et al., "Two regions in the CD80 cytoplasmic tail regulate CD80 redistribution and T cell costimulation," J Immunol. (1998) 161(6): 2700-2707.
Haile et al., "Soluble CD80 restores T cell activation and overcomes tumor cell programmed death ligand 1-mediated immune suppression,"J Immunol. (2013) 191(5):2829-36.
Hezareh et al., "Effector function activities of a panel of mutants of a broadly neutralizing antibody against human immunodeficiency virus type 1," J Virol (2001) 75(24):12161-12168.
Schildberg et al., "Coinhibitory Pathways in the B7-CD28 Ligand-Receptor Family," Immunity. (2016) 44(5): 955-72.

\* cited by examiner

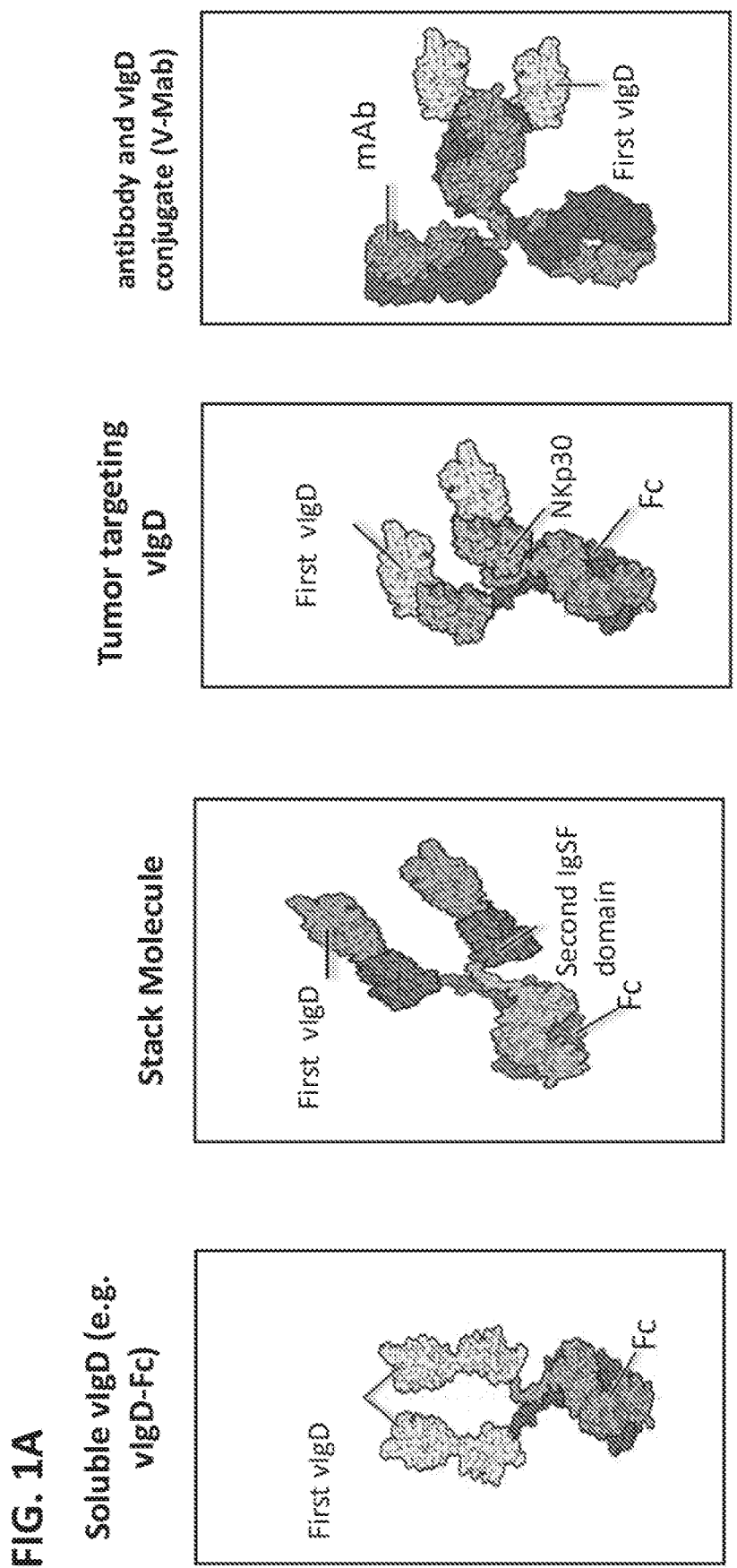

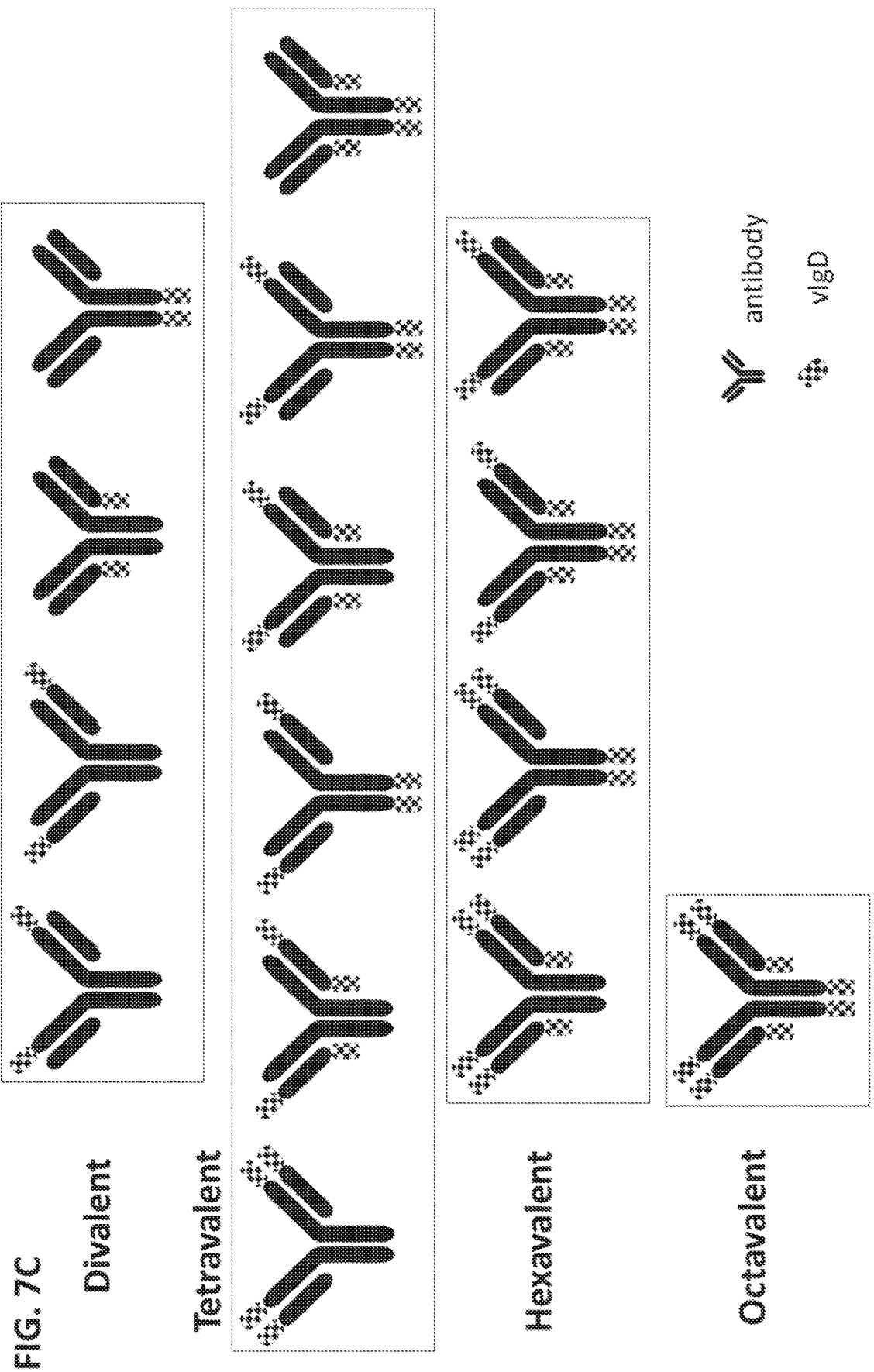

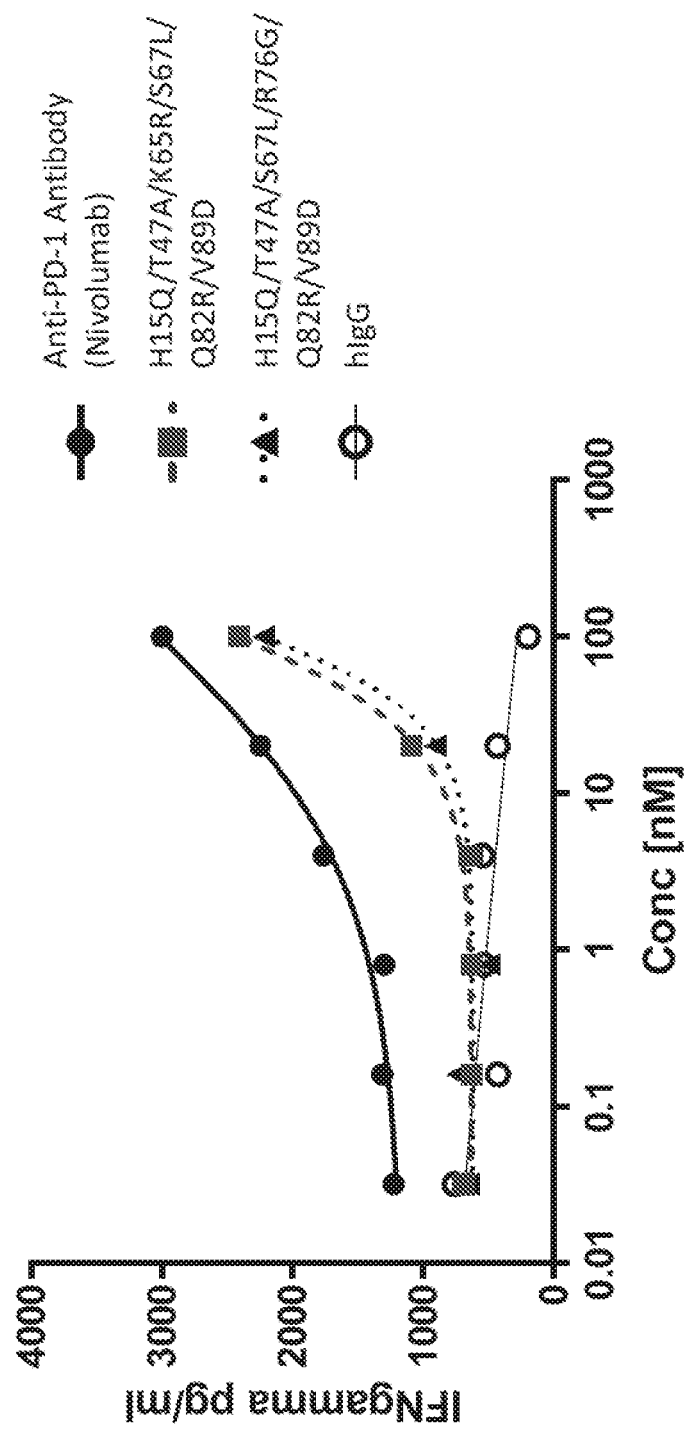

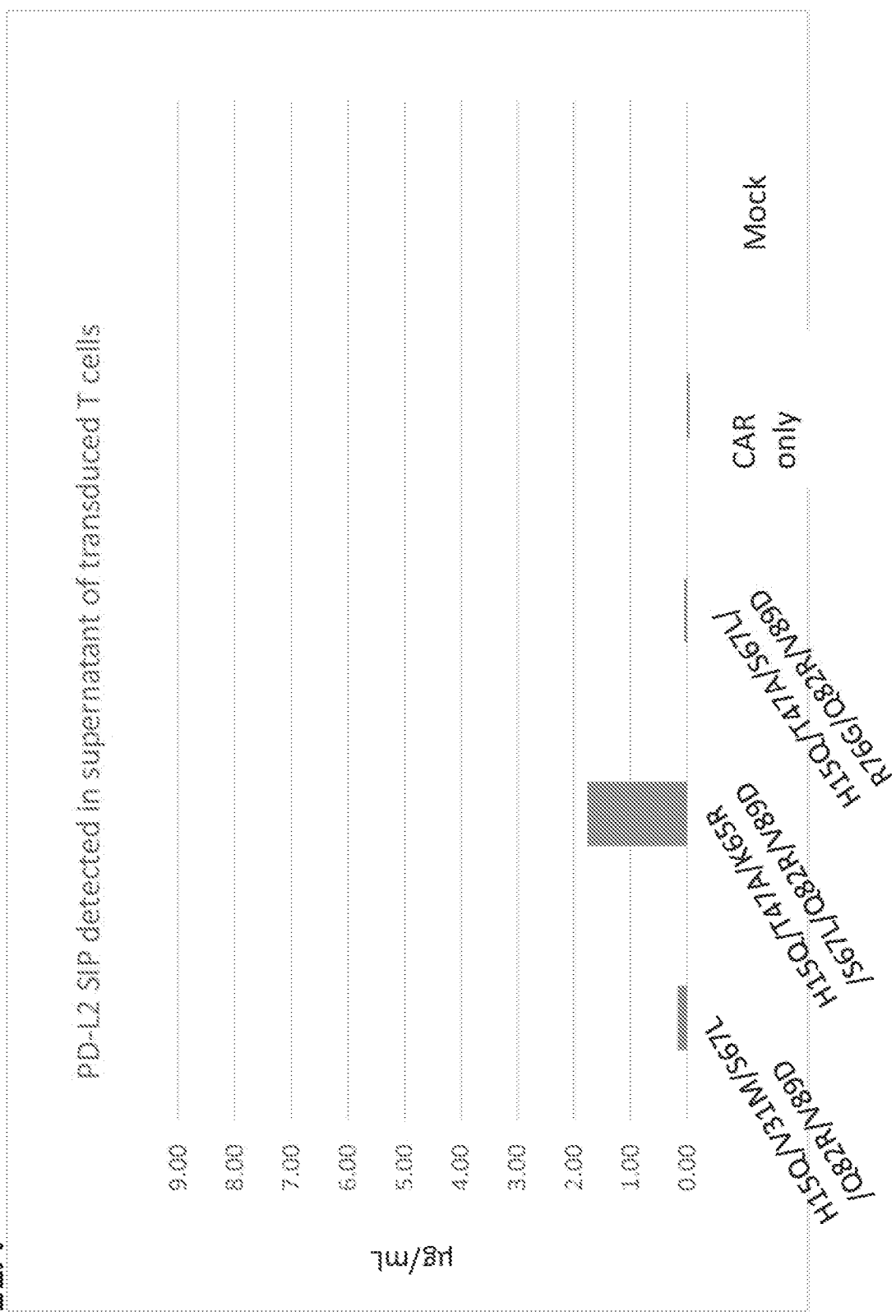

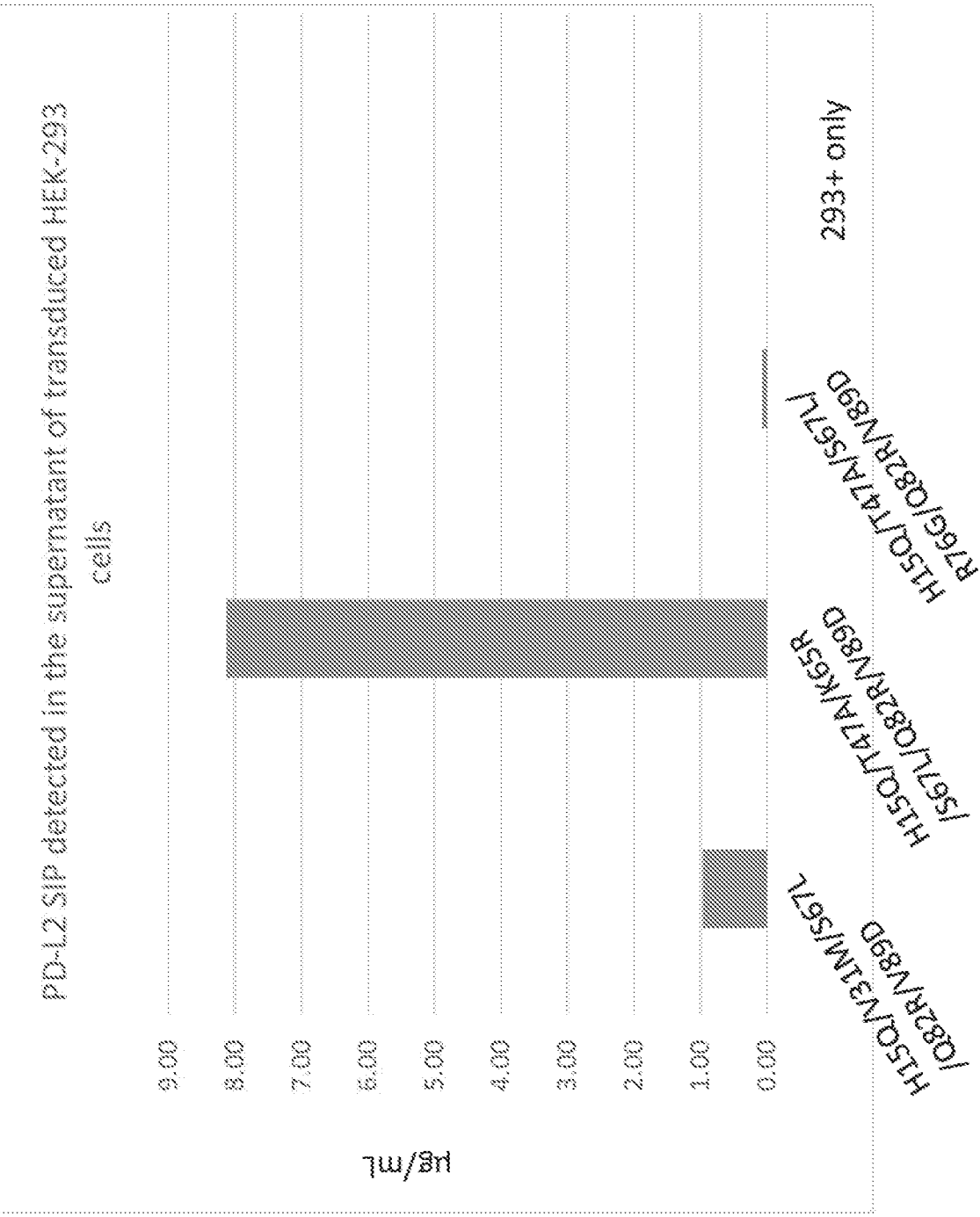

PD-L2 VARIANT IMMUNOMODULATORY PROTEINS AND USES THEREOF

CROSS-REFERENCE TO RELATED APPLICATIONS

This application is a U.S. National Stage of International Application No. PCT/US2018/022267 filed Mar. 13, 2018, which claims priority from U.S. provisional application No. 62/472,572 filed Mar. 16, 2017, entitled "PD-L2 Variant Immunomodulatory Proteins and Uses Thereof," U.S. provisional application No. 62/475,156 filed Mar. 22, 2017, entitled "PD-L2 Variant Immunomodulatory Proteins and Uses Thereof," and U.S. provisional application No. 62/537,928 filed Jul. 27, 2017, entitled "PD-L2 Variant Immunomodulatory Proteins and Uses Thereof," the contents of each of which are incorporated by reference in their entirety.

INCORPORATION BY REFERENCE OF SEQUENCE LISTING

The present application is being filed along with a Sequence Listing in electronic format. The Sequence Listing is provided as a file entitled 761612001500SeqList.txt, created Dec. 20, 2019 which is 3,353,515 bytes in size. The information in the electronic format of the Sequence Listing is incorporated by reference in its entirety.

FIELD

The present disclosure relates to therapeutic compositions for modulating immune response in the treatment of cancer and immunological diseases. In some aspects, the present disclosure relates to particular variants of PD-L2 that exhibit improved binding, such as improved binding affinity or selectivity, for one or more of the cognate binding partner proteins PD-1 and RGMb.

BACKGROUND

Modulation of the immune response by intervening in the processes that occur in the immunological synapse (IS) formed by and between antigen-presenting cells (APCs) or target cells and lymphocytes is of increasing medical interest. Mechanistically, cell surface proteins in the IS can involve the coordinated and often simultaneous interaction of multiple protein targets with a single protein to which they bind. IS interactions occur in close association with the junction of two cells, and a single protein in this structure can interact with both a protein on the same cell (cis) as well as a protein on the associated cell (trans), likely at the same time. Although therapeutics are known that can modulate the IS, improved therapeutics are needed. Provided are immunomodulatory proteins, including soluble proteins or transmembrane immunomodulatory proteins capable of being expressed on cells, that meet such needs.

SUMMARY

Provided herein is a variant PD-L2 polypeptide, containing an IgV domain or a specific binding fragment thereof, an IgC domain or a specific binding fragment thereof, or both, wherein the variant PD-L2 polypeptide contains one or more amino acid modifications in an unmodified PD-L2 or a specific binding fragment thereof corresponding to position(s) selected from 2, 12, 13, 15, 18, 20, 23, 24, 28, 31, 32, 33, 36, 37, 39, 44, 45, 46, 47, 48, 58, 59, 65, 67, 69, 71, 72, 73, 74, 75, 76, 77, 82, 85, 86, 89, or 91 with reference to numbering of SEQ ID NO:31. In some embodiments, the amino acid modification is an amino acid substitution, insertion or deletion.

In some embodiments, the unmodified PD-L2 is a mammalian PD-L2 or a specific binding fragment thereof. In some of any such embodiments, the unmodified PD-L2 is a human PD-L2 or a specific binding fragment thereof. In some of any such embodiments, the unmodified PD-L2 contains (i) the sequence of amino acids set forth in SEQ ID NO:31, (ii) a sequence of amino acids that has at least 95% sequence identity to SEQ ID NO:31; or (iii) a portion thereof containing an IgV domain or IgC domain or specific binding fragments thereof or both.

In some of any such embodiments, the specific binding fragment of the IgV domain or IgC domain has a length of at least 50, 60, 70, 80, 90, 100, 110 or more amino acids; or the specific binding fragment of the IgV domain contains a length that is at least 80% of the length of the IgV domain set forth as amino acids 24-130 of SEQ ID NO:4 and/or the specific binding fragment of the IgC domain contains a length that is at least 80% of the length of the IgC domain set forth as amino acids 122-203 of SEQ ID NO:4. In some of any such embodiments, the variant PD-L2 contains up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions. In some of any such embodiments, the variant PD-L2 polypeptide contains a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:31 or a specific binding fragment thereof.

In some of any such embodiments, the variant PD-L2 polypeptide exhibits altered binding to the ectodomain of PD-1 or RGMb compared to the binding of the unmodified PD-L2. In some of any such embodiments, the variant PD-L2 polypeptide exhibits altered binding to the ectodomain of PD-1 compared to the unmodified PD-L2. In some aspects, the altered binding is altered binding affinity and/or altered binding selectivity.

In some of any such embodiments, the one or more amino acid modifications are selected from F2L, I12V, I13V, H15Q, N18D, N24S, C23S, G28V, N24D, V31A, V31M, N32D, L33P, L33H, L33F, I36V, T37A, S48C, S39I, E44D, N45S, D46E, T47A, E58G, E59G, K65R, S67L, H69L, P71S, Q72H, V73A, Q74R, V75G, R76G, D77N, Q82R, I85F, I86T, V89D, W91R, or a conservative amino acid substitution thereof. In some of any such embodiments, the one or more amino acid modifications are selected from among H15Q, N24D, E44D, V89D, Q82R/V89D, E59G/Q82R, S39I/V89D, S67L/V89D, S67L/I85F, S67L/I86T, H15Q/K65R, H15Q/Q72H/V89D, H15Q/S67L/R76G, H15Q/R76G/I85F, H15Q/T47A/Q82R, H15Q/Q82R/V89D, H15Q/C23S/I86T, H15Q/S39I/I86T, E44D/V89D/W91R, I13V/S67L/V89D, H15Q/S67L/I86T, I13V/H15Q/S67L/I86T, I13V/H15Q/E44D/V89D, I13V/S39I/E44D/Q82R/V89D, I13V/E44D/Q82R/V89D, I13V/Q72H/R76G/I86T, I13V/H15Q/R76G/I85F, H15Q/S39I/R76G/V89D, H15Q/S67L/R76G/I85F, H15Q/T47A/Q72H/R76G/I86T, H15Q/T47A/Q72H/R76G, I13V/H15Q/T47A/Q72H/R76G, H15Q/E44D/R76G/I85F, H15Q/S39I/S67L/V89D, H15Q/N32D/S67L/V89D, N32D/S67L/V89D, H15Q/S67L/Q72H/R76G/V89D, H15Q/Q72H/Q74R/R76G/I86T, G28V/Q72H/R76G/I86T, I13V/H15Q/S39I/E44D/S67L, E44D/S67L/Q72H/Q82R/V89D, H15Q/V89D, H15Q/T47A, I13V/H15Q/Q82R, I13V/H15Q/V89D, I13V/S67L/Q82R/V89D, I13V/H15Q/Q82R/V89D, H15Q/V31M/

S67L/Q82R/V89D, I13V/H15Q/T47A/Q82R, I13V/H15Q/ V31A/N45S/Q82R/V89D, H15Q/T47A/H69L/Q82R/ V89D, I13V/H15Q/T47A/H69L/R76G/V89D, I12V/I13V/ H15Q/T47A/Q82R/V89D, I13V/H15Q/R76G/D77N/ Q82R/V89D, I13V/H15Q/T47A/R76G/V89D, I13V/H15Q/ T47A/Q82R/V89D, I13V/H15Q/N24D/Q82R/V89D, I13V/ H15Q/I36V/T47A/S67L/V89D, H15Q/T47A/K65R/S67L/ Q82R/V89D, H15Q/L33P/T47A/S67L/P71S/V89D, I13V/ H15Q/Q72H/R76G/I86T, H15Q/T47A/S67L/Q82R/V89D, F2L/H15Q/D46E/T47A/Q72H/R76G/Q82R/V89D, I13V/ H15Q/L33F/T47A/Q82R/V89D, I13V/H15Q/T47A/E58G/ S67L/Q82R/V89D, H15Q/N24S/T47A/Q72H/R76G/V89D, I13V/H15Q/E44V/T47A/Q82R/V89D, H15Q/N18D/T47A/ Q72H/V73A/R76G/I86T/V89D, I13V/H15Q/T37A/E44D/ S48C/S67L/Q82R/V89D, H15Q/L33H/S67L/R76G/Q82R/ V89D, I13V/H15Q/T47A/Q72H/R76G/I86T, H15Q/S39I/ E44D/Q72H/V75G/R76G/Q82R/V89D, H15Q/T47A/ S67L/R76G/Q82R/V89D, or I13V/H15Q/T47A/S67L/ Q72H/R76G/Q82R/V89D.

In some of any such embodiments, the one or more amino acid substitutions correspond to position(s) selected from 13, 15, 39, 44, 47 67, 72, 76, 82, 85, 86, or 89. In some of any such embodiments, the one or more amino acid substitutions are selected from I13V, H15Q, E44D, T47A, S67L, Q72H, R76G, Q82R, I85F, I86T, V89D, or a conservative amino acid substitution thereof. In some of any such embodiments, the one or more amino acid substitutions correspond to position(s) selected from 13, 15, 44, 47, 67, 72, 76, 82, 86, or 89. In some of any such embodiments, the one or more amino acid substitutions are selected from I13V, H15Q, E44D, T47A, S67L, Q72H, R76G, Q82R, I86T, V89D, or a conservative amino acid substitution thereof.

In some embodiments, the variant PD-L2 polypeptide contains amino acid modifications I13V/H15Q, I13V/T47A, I13V/S67L, I13V/Q72H, I13V/Q72H, I13V/R76G, I13V/ Q82R, I13V/I86T, I13V/V89D, H15Q/T47A, H15Q/S67L, H15Q/Q72H, H15Q/Q72H, H15Q/R76G, H15Q/Q82R, H15Q/I86T, H15Q/V89D, T47A/S67L, T47A/Q72H, T47A/ Q72H, T47A/R76G, T47A/Q82R, T47A/I86T, T47A/V89D, S67L/Q72H, S67L/Q72H, S67L/R76G, S67L/Q82R, S67L/ I86T, S67L/V89D, Q72H/R76G, Q72H/Q82R, Q72H/I86T, Q72H/V89D, R76G/Q82R, R76G/I86T, R76G/V89D, Q82R/I86T, Q82R/V89D or I86T/V89D. In some examples, the variant PD-L2 polypeptide contains amino acid modifications H15Q/S62L/Q82R, H15Q/S62L/V89D, H15Q/ Q82R/V89D, or S62L/Q82R/V89D. In some instances, the variant PD-L2 polypeptide contains amino acid modifications H15Q/T47A/K65R/S67L/Q82R/V89D.

In some of any such embodiments, the variant PD-L2 polypeptide contains the IgV domain or a specific fragment thereof and the IgC domain or a specific fragment thereof. In some of any such embodiments, the variant PD-L2 polypeptide includes the sequence of amino acids set forth in any of SEQ ID NOS: 56-106, 108-114, 116-132 or a specific binding fragment thereof, or a sequence of amino acids that exhibits at least 95% sequence identity to any of SEQ ID NOS: 56-106, 108-114, 116-132 or a specific binding fragment thereof and that contains the one or more of the amino acid substitutions.

In some of any such embodiments, the variant PD-L2 polypeptide contains the IgV domain or a specific binding fragment thereof. In some of any such embodiments, the IgV domain or specific binding fragment thereof is the only PD-L2 portion of the variant PD-L2 polypeptide. In some of any such embodiments, the IgC domain or specific binding fragment thereof is the only PD-L2 portion of the variant PD-L2 polypeptide.

In some of any such embodiments, the variant PD-L2 polypeptide contains the sequence of amino acids set forth in any of SEQ ID NOS: 133-183, 185-191, 193-209, 268-318, 320-343 or a specific binding fragment thereof, a sequence of amino acids that exhibits at least 95% sequence identity to any of SEQ ID NOS: 133-183, 185-191, 193-209, 268-318, 320-343 or a specific binding fragment thereof and that contains the one or more of the amino acid substitutions. In some embodiments, the IgC domain or specific binding fragment thereof is the only PD-L2 portion of the variant PD-L2 polypeptide.

In some of any such embodiments, the variant PD-L2 polypeptide specifically binds to the ectodomain of PD-1 or RGMb with increased affinity compared to the binding of the unmodified PD-L2 to the ectodomain of PD-1 or RGMb. In some of any such embodiments, the variant PD-L2 polypeptide specifically binds to the ectodomain of PD-1 with increased affinity compared to binding of the unmodified PD-L2 to the ectodomain of PD-1. In some of any such embodiments, the variant PD-L2 polypeptide specifically binds to the ectodomain of PD-1 and the ectodomain of RGMb each with increased affinity compared to the binding of the unmodified PD-L2 to the ectodomain of PD-1 and the ectodomain of RGMb. In some of any such embodiments, the variant PD-L2 polypeptide specifically binds to the ectodomain of PD-1 with increased affinity and specifically binds to the ectodomain of the other of RGMb with decreased affinity compared to the binding of the unmodified PD-L2 to the ectodomain of the PD-1 or RGMb.

In some of any such embodiments, the increased affinity to the ectodomain of PD-1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the unmodified PD-L2. In some embodiments, the increased affinity to the ectodomain of RGMb is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the unmodified PD-L2. In some aspects, the decreased affinity to the ectodomain of RGMb is decreased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the unmodified PD-L2.

In some of any such embodiments, the variant polypeptide specifically binds to the ectodomain of PD-1 with increased selectivity compared to the unmodified PD-L2. In some instances, the increased selectivity includes a greater ratio of binding of the variant polypeptide for PD-1 versus RGMb compared to the ratio of binding of the unmodified PD-L2 polypeptide for PD-1 versus RGMb. In some instances, the ratio is greater by at least or at least about 1.5-fold, 2.0-fold, 3.0-fold, 4.0-fold, 5.0-fold, 10-fold, 15-fold, 20-fold, 30-fold, 40-fold, 50-fold or more.

In some of any such embodiments, the PD-1 is a human PD-1. In some of any such embodiments, the RGMb is a human RGMb.

In some of any such embodiments, the binding activity is altered (increased or decreased) more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold compared to the unmodified PD-L2.

In some of any such embodiments, the variant PD-L2 polypeptide is a soluble protein. In some embodiments, the variant PD-L2 polypeptide lacks the PD-L2 transmembrane domain and intracellular signaling domain; and/or the variant PD-L2 polypeptide is not capable of being expressed on the surface of a cell.

In some of any such embodiments, the variant PD-L2 polypeptide is linked to a multimerization domain. In some of any such embodiments, the variant PD-L2 polypeptide is a multimeric polypeptide, optionally a dimeric polypeptide, containing a first variant PD-L2 polypeptide linked to a multimerization domain and a second variant PD-L2 polypeptide linked to a multimerization domain. In some embodiments, the first variant PD-L2 polypeptide and the second variant PD-L2 polypeptide are the same or different.

In some of any such embodiments, the multimerization domain is an Fc domain or a variant thereof with reduced effector function. In some of any such embodiments, the variant PD-L2 polypeptide is linked to a moiety that increases biological half-life of the polypeptide. In some of any such embodiments, the variant PD-L2 polypeptide is linked to an Fc domain or a variant thereof with reduced effector function.

In some embodiments, the Fc domain is mammalian, optionally human; or the variant Fc domain contains one or more amino acid modifications compared to an unmodified Fc domain that is mammalian, optionally human. In some embodiments, the Fc domain or variant thereof contains the sequence of amino acids set forth in SEQ ID NO:211 or SEQ ID NO:212 or a sequence of amino acids that exhibits at least 85% sequence identity to SEQ ID NO:211 or SEQ ID NO:212. In some of any such embodiments, the Fc domain contains one or more amino acid modifications selected from among E233P, L234A, L234V, L235A, L235E, G236del, G237A, S267K, N297G, V302C, and K447del each by EU numbering. In some embodiments, the Fc domain contains the amino acid modification C220S by EU numbering. In some embodiments, the Fc domain contains the sequence of amino acids set forth in any of SEQ ID NOS: 1189, 1205, 1206, 1207, 1739, 1738, 1739, 1740 or a sequence of amino acids that exhibits at least 85% sequence identity to any of SEQ ID NOS: 1189, 1205, 1206, 1207, 1739, 1738, 1739, 1740 and exhibits reduced effector function.

In some of any such embodiments, the variant PD-L2 polypeptide is linked indirectly via a linker, optionally a G4S linker. In some of any such embodiments, the variant PD-L2 polypeptide is a transmembrane immunomodulatory protein further containing a transmembrane domain linked to the extracellular domain (ECD) or specific binding fragment thereof of the variant PD-L2 polypeptide. In some instances, the transmembrane domain contains the sequence of amino acids set forth as residues 221-241 of SEQ ID NO:4 or a functional variant thereof that exhibits at least 85% sequence identity to residues 221-241 of SEQ ID NO:4. In some embodiments, the variant PD-L2 polypeptide further contains a cytoplasmic signaling domain linked to the transmembrane domain. In some aspects, the cytoplasmic signaling domain includes the sequence of amino acids set forth as residues 242-273 of SEQ ID NO:4 or a functional variant thereof that exhibits at least 85% sequence identity to residues 242-273 of SEQ ID NO:4.

In some of any of the provided embodiments, the variant PD-L2 polypeptide modulates a response of an immune cell, such as a T cell. In some embodiments, the response, e.g. T cell response, is increased or is decreased. In some of any such embodiments, the variant PD-L2 increases IFN-gamma (interferon-gamma) expression relative to the unmodified PD-L2 in an in vitro T-cell assay. In some of any such embodiments, the variant PD-L2 decreases IFN-gamma (interferon-gamma) expression relative to the unmodified PD-L2 in an in vitro T-cell assay.

In some embodiments of any one of the variant PD-L2 polypeptides described herein, the variant PD-L2 polypeptide increases T cell signaling relative to the unmodified PD-L2 such as determined using a reporter assay involving a T cell (e.g. Jurkat) engineered with a reporter (e.g. luciferase) operably connected to an IL-2 promoter. In some embodiments of any one of the variant PD-L2 polypeptides described herein, the variant PD-L2 polypeptide decreases T cell signaling relative to the unmodified PD-L2, such as determined using a reporter assay involving a T cell (e.g. Jurkat) engineered with a reporter (e.g. luciferase) operably connected to an IL-2 promoter. In some of any such embodiments, the variant PD-L2 polypeptide is provided in any of a variety of formats, such as soluble or immobilized (e.g. plate-bound).

In some of any such embodiments, the variant PD-L2 polypeptide is deglycosylated.

Also provided is an immunomodulatory polypeptide containing the variant PD-L2 according to any of the provided embodiments linked, directly of indirectly via a linker, to a second polypeptide containing an immunoglobulin superfamily (IgSF) domain. In some cases, the IgSF domain is affinity modified and exhibits altered binding to one or more of its cognate binding partner(s) compared to the unmodified or wild-type IgSF domain. In some instances, the IgSF domain exhibits increased binding to one or more of its cognate binding partner(s) compared to the unmodified or wild-type IgSF domain to the same one or more cognate binding partner(s).

In some of any such embodiments, the variant PD-L2 is a first PD-L2 variant and the IgSF domain of the second polypeptide is an IgSF domain from a second variant PD-L2 of any of the provided embodiments, wherein the first and second PD-L2 variant are the same or different. In some embodiments, the variant PD-L2 polypeptide is capable of specifically binding to PD-1 or RGMb and the IgSF domain of the second polypeptide is capable of binding to a cognate binding partner other than one specifically bound by the PD-L2 variant polypeptide.

In some of any such embodiments, the IgSF domain is from a member of the B7 family. In some embodiments, the IgSF domain is a tumor-localizing moiety that binds to a ligand expressed on a tumor. In some cases, the ligand is B7H6. In some aspects, the IgSF domain is from NKp30.

In some of any such embodiments, the IgSF domain or affinity-modified IgSF domain thereof, optionally of the second or third polypeptide, is or contains an IgV domain. In some embodiments, the variant PD-L2 polypeptide is or contains an IgV domain. In some of any such embodiments, the immunomodulatory protein contains a multimerization domain linked to one or both of the variant PD-L2 polypeptide of the IgSF domain.

In some embodiments, the multimerization domain is an Fc domain or a variant thereof with reduced effector function. In some embodiments, the immunomodulatory protein is dimeric. In some cases, the immunomodulatory protein is homodimeric. In some instances, the immunomodulatory protein is heterodimeric.

In some of any such embodiments, the IgSF domain of the second polypeptide is an IgSF domain of a ligand that binds to an inhibitory receptor, or is an affinity-modified IgSF domain thereof. In some instances, the affinity-modified IgSF domain exhibits increased binding affinity and/or binding selectivity for the inhibitory receptor compared to binding of the unmodified IgSF domain to the same inhibitory receptor. In some embodiments, the inhibitory receptor is TIGIT or CTLA-4; or the ligand of the inhibitory receptor is CD155, CD112 or CD80.

In some of any such embodiments, the IgSF domain of the second polypeptide is an affinity-modified IgSF domain containing (i) a wildtype CD155 comprising an IgSF set forth in any of SEQ ID NOS: 47, 344, or 387, or a variant CD155 polypeptide comprising an IgSF domain of any of SEQ ID NOs set forth in Table 5, optionally any of the SEQ ID NOs: 345-386, 388-699, 1527-1736; (ii) a wildtype CD112 comprising an IgSF domain set forth in any of SEQ ID NOS: 48, 700, or 795, or a variant CD112 polypeptide comprising an IgSF domain of any of SEQ ID NOS set forth in Table 4, optionally any of the SEQ ID NOs: 701-794, 796-965, 1455-1526; (iii) a wildtype CD80 comprising an IgSF set forth in any of SEQ ID NOS:28, 1039, or 2039, or a variant CD80 polypeptide comprising an IgSF of any of SEQ ID NOS set forth in Table 3, optionally any of the SEQ ID NOs: 28, 966-998, 1000-1072, 1074-1146, 1147-1186; (iv) a wildtype PD-L1 comprising an IgSF set forth in any of SEQ ID NOS: 30, 1812, 1258, or 1454, or a variant PD-L1 polypeptide comprising an IgSF of any of SEQ ID NOS set forth in Table 8, optionally any of SEQ ID NOS: 1259-1453, 1743-1811, 1813-2021; (v) a sequence of amino acids that exhibits at least 95% sequence identity to any of the SEQ ID NOs in (i)-(iv) and that contains the amino acid substitution; or (vi) a specific binding fragment of any of (i)-(v).

In some embodiments, the immunomodulatory protein further contains a third polypeptide containing a wild-type IgSF domain or a variant or affinity-modified IgSF domain thereof, said affinity-modified IgSF domain comprising one or more amino acid modifications compared to the unmodified or wild-type IgSF domain of the IgSF family member, wherein the third polypeptide is the same as the first and/or second polypeptide; or the third polypeptide is different from the first and/or second polypeptide.

In some examples, the IgSF domain of the third polypeptide is an affinity-modified IgSF domain containing: (i) a wildtype CD155 comprising an IgSF set forth in any of SEQ ID NOS: 47, 344, or 387, or a variant CD155 polypeptide comprising an IgSF domain set forth in any of SEQ ID NOS: 345-386, 388-699, 1527-1736; (ii) a wildtype CD112 comprising an IgSF domain set forth in any of SEQ ID NOS: 48, 700, or 795, or a variant CD112 polypeptide comprising an IgSF domain set forth in any of SEQ ID NOS: 701-794, 796-965, 1455-1526; (iii) a wildtype CD80 comprising an IgSF set forth in any of SEQ ID NOS:28, 1039, or 2039, or a variant CD80 polypeptide comprising an IgSF domain set forth in any of SEQ ID NOS: 966-998, 1000-1038, 1040-1072, 1074-1112, 1114-1146, 1147-1186; (iv) a wildtype PD-L1 comprising an IgSF set forth in any of SEQ ID NOS: 30, 1812, 1258, or 1454, or a variant PD-L1 polypeptide comprising an IgSF domain set forth in any of SEQ ID NOS:1259-1453, 1743-1811, 1813-2021; (v) a sequence of amino acids that exhibits at least 95% sequence identity to any of the SEQ ID NOS in (i)-(iv) and that comprises the amino acid modifications, optionally amino acid substitutions, insertions and/or deletions thereof; or (vi) a specific binding fragment of any of (i)-(v).

In some of any such embodiments, the immunomodulatory protein further contains at least one additional polypeptide containing an IgSF domain of an IgSF family member or an affinity-modified IgSF domain thereof, said affinity-modified IgSF domain comprising one or more amino acid modifications compared to the binding of the unmodified or wild-type IgSF domain of the IgSF family member.

In some embodiments, the immunomodulatory protein further contains a multimerization domain linked to at least one of the variant PD-L2 polypeptide, the second polypeptide and/or the third polypeptide, optionally wherein the multimerization domain is an Fc domain or a variant thereof with reduced effector function.

In some embodiments, the multimerization domain promotes heterodimer formation.

Provided is an immunomodulatory protein containing a first variant PD-L2 polypeptide in which the multimerization domain is a first multimerization domain and a second variant PD-L2 polypeptide in which the multimerization domain is a second multimerization domain, wherein the first and second multimerization domains interact to form a multimer containing the first and second variant PD-L2 polypeptide, optionally wherein the first and second variant PD-L2 polypeptides are the same. Also provided is an immunomodulatory protein containing any of the provided immunomodulatory proteins, wherein the multimerization domain is a first multimerization domain and interacts with a second multimerization domain to form a multimer containing the immunomodulatory protein.

In some embodiments, the immunomodulatory protein is a first immunomodulatory protein and a second immunomodulatory protein is linked directly or indirectly via a linker to the second multimerization domain, wherein the multimer contains the first and second immunomodulatory protein. In some cases, the second immunomodulatory protein is an immunomodulatory protein as described herein and the multimerization domain is the second multimerization domain. In some embodiments, the multimer is a dimer. In some aspects, the immunomodulatory protein is a homodimer, optionally wherein the first and second multimerization domain is the same.

In some embodiments, the second polypeptide is a variant CD155 polypeptide and the first and/or second immunomodulatory protein includes the sequence set forth in any of SEQ ID NOS: 1191-1196, or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 1191-1196. In some cases, the immunomodulatory protein is a heterodimer, optionally wherein the first and second multimerization domain are different and/or are capable of interacting to mediate heterodimer formation. In some examples, the second polypeptide is a variant CD155 polypeptide and: the first or second immunomodulatory protein contains the sequence set forth in any of SEQ ID NOS: 1197, 1198, 1199, 1200, 1201, 1203 or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 1197, 1198, 1199, 1200, 1201 or 1203; and the other of the first or second immunomodulatory protein includes the sequence set forth in any of SEQ ID NOS: 1188, 1190, 1202 or 1204, or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 1188, 1190, 1202 or 1204.

In some embodiments, the first and/or second multimerization domain is an Fc domain or a variant thereof with reduced effector function, optionally wherein the Fc domain is of an immunoglobulin protein that is human and/or the Fc region is human, optionally wherein the Fc region is of an immunoglobulin G1 (IgG1) or an immunoglobulin G2 (IgG2), optionally set forth in SEQ ID NO:211 or SEQ ID NO:212; or the variant Fc domain contains one or more amino acid substitutions in a wildtype Fc region, optionally wherein the reduced effector function is reduced compared to a wildtype Fc region, optionally wherein the wildtype human Fc is of human IgG1.

In some of any such embodiments, the first and second multimerization domain is the same or different. In some examples, the variant Fc region contains the amino acid substitutions E233P, L234A, L234V, L235A, L235E, G236del, G237A, S267K, or N297G, with residue numbering according to the EU index of Kabat; or the amino acid substitutions R292C/N297G/V302C or L234A/L235E/G237A, with residue numbering according to the EU index of Kabat. In some cases, the Fc region or variant Fc region contains the amino acid substitution C220S, with residue numbering according to the EU index of Kabat. In some examples, the Fc region or variant Fc region contains K447del, with residue numbering according to the EU index of Kabat.

In some of any such embodiments, the sequence of amino acids set forth in any of SEQ ID NOS: 1191-1204 or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 1191-1204.

Also provided is a conjugate containing a variant PD-L2 according to any of the provided embodiments or an immunomodulatory polypeptide according to any of the provided embodiments linked to a moiety. In some cases, the moiety is a targeting moiety that specifically binds to a molecule on the surface of a cell. In some instances, the targeting moiety specifically binds to a molecule on the surface of an immune cell. In some embodiments, the immune cell is an antigen presenting cell or a lymphocyte.

In some cases, the targeting moiety is a tumor-localizing moiety that binds to a molecule on the surface of a tumor. In some of any such embodiments, the moiety is a protein, a peptide, nucleic acid, small molecule or nanoparticle. In some of any such embodiments, the moiety is an antibody or antigen-binding fragment. In some of any such embodiments, the conjugate is divalent, tetravalent, hexavalent or octavalent. In some cases, the conjugate is a fusion protein.

Also provided is a nucleic acid molecule(s) encoding a variant PD-L2 polypeptide according to any of the provided embodiments, a conjugate that is a fusion protein according to any of the provided embodiments, or an immunomodulatory polypeptide according to any of the provided embodiments. In some embodiments, the nucleic acid molecule is synthetic nucleic acid. In some instances, the nucleic acid molecule is cDNA.

Also provided is a vector containing the nucleic acid molecule according to any of the provided embodiments. In some cases, the vector is an expression vector. In some embodiments, the vector is a mammalian expression vector or a viral vector.

Also provided is a cell containing the vector of any of the provided embodiments. In some cases, the cell is a mammalian cell. In some aspect, the cell is a human cell.

Also provided is a method of producing a variant PD-L2 polypeptide or an immunomodulatory protein, including introducing the nucleic acid molecule according to any of the provided embodiments or vector according to any of the provided embodiments into a host cell under conditions to express the protein in the cell. In some cases, the method further includes isolating or purifying the variant PD-L2 polypeptide or immunomodulatory protein from the cell.

Also provided is a method of engineering a cell expressing a variant PD-L2 variant polypeptide, including introducing a nucleic acid molecule encoding the variant PD-L2 polypeptide according to any of the provided embodiments into a host cell under conditions in which the polypeptide is expressed in the cell.

Also provided is an engineered cell, expressing the variant PD-L2 polypeptide according to any of the provided embodiments, a conjugate that is a fusion protein according to any of the provided embodiments, the immunomodulatory protein according to any of the provided embodiments, the nucleic acid molecule according to any of the provided embodiments, or the vector according to any of the embodiments.

In some cases the variant PD-L2 polypeptide or immunomodulatory protein contains a signal peptide. In some embodiments, the variant PD-L2 polypeptide or immunomodulatory protein does not contain a transmembrane domain and/or is not expressed on the surface of the cell. In some embodiments, the variant PD-L2 polypeptide or immunomodulatory protein is secreted or is capable of being secreted from the engineered cell. In some embodiments, the engineered cell contains a variant PD-L2 polypeptide that contains a transmembrane domain and/or is the transmembrane immunomodulatory protein according to any of the provided embodiments. In some embodiments, the variant PD-L2 polypeptide is expressed on the surface of the cell.

In some of any such embodiments, the cell is an immune cell. In some cases, the immune cell is an antigen presenting cell (APC) or a lymphocyte. In some embodiments, the engineered cell is a primary cell. In some embodiments, the cell is a mammalian cell. In some embodiments, the cell is a human cell. In some embodiments, the cell is a lymphocyte and the lymphocyte is a T cell. In some cases, the cell is an APC and the APC is an artificial APC. In some examples, the engineered cell is a primary cell. In some cases, the cell is a mammalian cell. In some instances, the cell is a human cell. In some embodiments, the engineered cell further contains a chimeric antigen receptor (CAR) or an engineered T-cell receptor.

Also provided is an infectious agent, containing a nucleic acid molecule encoding a variant PD-L2 polypeptide according to any of the provided embodiments or an immunomodulatory polypeptide according to any of the provided embodiments. In some cases, the encoded variant PD-L2 polypeptide or immunomodulatory polypeptide does not contain a transmembrane domain and/or is not expressed on the surface of a cell in which it is expressed. In some embodiments, the encoded variant PD-L2 polypeptide or immunomodulatory polypeptide is secreted from a cell in which it is expressed. In some cases, the encoded variant PD-L2 polypeptide contains a transmembrane domain. In some embodiments, the encoded variant PD-L2 polypeptide is expressed on the surface of a cell in which it is expressed.

In some of any such embodiments, the infectious agent is a bacterium or a virus. In some embodiments, the virus is a lentiviral or retroviral construct or a hybrid thereof. In some instances, the virus is an oncolytic virus. In some examples, the oncolytic virus is an adenovirus, adeno-associated virus, herpes virus, Herpes Simplex Virus, Vesticular Stomatic virus, Reovirus, Newcastle Disease virus, parvovirus, measles virus, vesticular stomatitis virus (VSV), Coxsackie virus or a Vaccinia virus. In some aspects, the virus specifically targets dendritic cells (DCs) and/or is dendritic cell-tropic. In some embodiments, the virus is a lentiviral vector that is pseudotyped with a modified Sindbis virus envelope product.

In some embodiments, the infectious agent further contains a nucleic acid molecule encoding a further gene product that results in death of a target cell or that can augment or boost an immune response. In some cases, the further gene product is selected from an anticancer agent, anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or a reprogramming human somatic cells to pluripotency.

Also provided is a pharmaceutical composition containing the variant PD-L2 polypeptide according to any of the provided embodiments, an immunomodulatory protein according to any of the provided embodiments, a conjugate according to any of the provided embodiments, or an engineered cell according to any of the provided embodiments. In some instances, the pharmaceutical composition contains a pharmaceutically acceptable excipient. In some embodiments, the pharmaceutical composition is sterile.

Also provided is an article of manufacture containing the pharmaceutical composition of according to any of the provided embodiments in a vial. In some cases, the vial is sealed.

Also provided is a kit containing the pharmaceutical composition according to any of the provided embodiments and instructions for use. Also provided is a kit containing the article of manufacture according to any of the provided embodiments and instructions for use.

Also provided is a method of modulating an immune response, such as increasing or decreasing an immune response in a subject including administering the pharmaceutical composition according to any of the provided embodiments to the subject. In some cases the method includes administering the engineered cells according to any of the provided embodiments. In some examples, the engineered cells are autologous to the subject. In some cases, the engineered cells are allogenic to the subject. In some embodiments, the method comprises administering to the subject a soluble variant PD-L2 polypeptide according to any one of the embodiments described herein, an immunomodulatory protein according to any one of the embodiments described herein or a conjugate according to any one of the embodiments described herein. In some embodiments, the method comprises administering to the subject an infectious agent encoding a variant PD-L2 polypeptide according to any one of the embodiments described herein.

In some embodiments, the method modulating the immune response treats a disease or condition in the subject.

In some of any such embodiments, the immune response is increased. Various formats of a variant PD-L2 polypeptide are contemplated for administration to a subject to increase an immune response, such as antagonist formats of a variant PD-L2. In some cases, such methods are carried out under conditions in which signaling by the inhibitory receptor PD-1 is blocked or attenuated by the administration. In some of any such embodiments, the method includes a variant PD-L2 polypeptide or immunomodulatory protein that is soluble is administered to the subject. In some instances, the soluble immunomodulatory protein is an immunomodulatory Fc fusion protein. In some embodiments of the method, a variant PD-L2 polypeptide according to any of the provided embodiments, or the immunomodulatory protein according to any of the provided embodiments is administered to the subject.

In some embodiments, an engineered cell containing a secretable variant PD-L2 polypeptide is administered to the subject. In some embodiments, an engineered cell according to any of the provided embodiments is administered to the subject. In some embodiments, an infectious agent encoding a variant PD-L2 polypeptide that is a secretable immunomodulatory protein is administered to the subject, optionally under conditions in which the infectious agent infects a tumor cell or immune cell and the secretable immunomodulatory protein is secreted from the infected cell.

In some of any such embodiments, the disease or condition is a tumor or cancer. In some embodiments, the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some of any such embodiments, the variant PD-L2 is administered in a format that increases an immune response in the subject.

In some of any such embodiments, the immune response is decreased. Various formats of a variant PD-L2 polypeptide are contemplated for administration to a subject to decrease an immune response, such as agonist formats of a variant PD-L2. In some cases, such methods are carried out under conditions in which signaling by the inhibitory receptor PD-1 is activated or stimulated or induced by the administration. In some embodiments, an immunomodulatory protein or conjugate comprising a variant PD-L2 polypeptide linked to an IgSF domain or a moiety that localizes to a cell or tissue of an inflammatory environment is administered to the subject. In some instances, the binding molecule contains an antibody or an antigen-binding fragment thereof or contains a wild-type IgSF domain or variant thereof.

In some embodiments, the immunomodulatory protein according to any of the provided embodiments or the conjugate according to any of the provided embodiments is administered to the subject. In some embodiments, a variant PD-L2 polypeptide that is a transmembrane immunomodulatory protein is administered to the subject. In some of any such embodiments, the engineered cell containing a variant PD-L2 polypeptide that is a transmembrane immunomodulatory protein according to any of the provided embodiments is administered to the subject. In some embodiments, an infectious agent encoding a variant PD-L2 polypeptide that is a transmembrane immunomodulatory protein is administered to the subject, optionally under conditions in which the infectious agent infects a tumor cell or immune cell and the transmembrane immunomodulatory protein is expressed on the surface of the infected cell.

In some of any such embodiments, the disease or condition is an inflammatory or autoimmune disease or condition. In some embodiments, the disease or condition is an anti-neutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease. In some embodiments, the disease or condition is selected from inflammatory bowel disease, transplant, Crohn's disease, ulcerative colitis, multiple sclerosis, asthma, rheumatoid arthritis, or psoriasis. In some of any such embodiments, the variant PD-L2 is administered in a format that decreases an immune response in the subject.

BRIEF DESCRIPTION OF THE DRAWINGS

FIG. 1A-1C depicts various formats of the provided variant IgSF domain molecules. FIG. 1A depicts soluble molecules, including: (1) a variant IgSF domain (vIgD) fused to an Fc chain; (2) a stack molecule containing a first variant IgSF domain (first vIgD) and a second IgSF domain, such as a second variant IgSF domain (second vIgD); (3) a tumor targeting IgSF molecule containing a first variant IgSF domain (vIgD) and an IgSF domain that targets to a tumor antigen, such as an NKp30 IgSF domain; and (4) a variant IgSF domain (vIgD) linked to an antibody (V-mAb). FIG. 1B depicts a transmembrane immunomodulatory protein (TIP) containing a variant IgSF domain (vIgD) expressed on the surface of a cell. In an exemplary embodiment, the cognate binding partner of the transmembrane bound vIgD is an inhibitory receptor (e.g. PD-1), and the TIP containing the vIgD (e.g. PD-L2 vIgD) antagonizes or blocks the negative signaling of the inhibitory receptor, thereby resulting in an activated T cell or effector T cell. In some cases, if clustering of the inhibitory receptor (PD-1) is proximal to an activating receptor (e.g. CD28) then agonizing activity by the TIP may be realized. FIG. 1C depicts a secreted immunomodulatory protein (SIP) in which a variant IgSF domain (vIgD) is secreted from a cell, such as a first T cell (e.g. CAR T cell). In an exemplary embodiment, the cognate binding partner of the secreted vIgD is an inhibitory receptor (e.g. PD-1), which can be expressed by the first cell (e.g. T cell, such as a CAR T cell) and/or on a second cell (e.g. T cell; either endogenous or engineered, such as a CAR T cell). Upon binding of the SIP with its cognate binding partner, the SIP antagonizes or blocks the negative signaling via the inhibitory receptor, thereby resulting in an activated T cell or effector T cell. In all cases, the vIgD can be a V-domain (IgV) only, the combination of the V-domain (IgV) and C-domain (IgC), including the entire extracellular domain (ECD), or any combination of Ig domains of the IgSF superfamily member.

FIG. 7A-7C depicts various exemplary configurations of a variant IgSF-antibody conjugate (V-Mab). FIG. 7A shows various configurations in which a variant IgSF domain is linked, directly or indirectly, to the N- and/or C-terminus of the light chain of an antibody. FIG. 7B shows various configurations in which a variant IgSF domain is linked, directly or indirectly, to the N- and/or C-terminus of the heavy chain of an antibody. FIG. 7C depicts the results V-Mab configurations when a light chain of FIG. 7A and a heavy chain of FIG. 7B are co-expressed in a cell.

FIG. 9 and FIG. 10 depict the results for soluble variant PD-L2 IgV-Fc bioactivity tested in a human Mixed Lymphocyte Reaction (MLR). Approximately, 10,000 matured DC and 100,000 purified allogeneic CD4+ T cells were co-cultured with various increasing concentrations of variant PD-L2 IgV-Fc fusion proteins in 96 well round-bottom plates. Irrelevant human IgG or media only (designated "No Add") were used as negative controls. As controls, either wildtype PDL2-Fc (full PD-L2 extracellular domain), wild-type PD-L2 IgV-Fc and or positive control anti-PD-1 monoclonal antibody (nivolumab) was assessed. IFN-gamma secretion in culture supernatants was analyzed and shown in FIG. 9 and FIG. 10.

FIG. 11A and FIG. 11B depicts the detection of PD-L2 SIP in supernatant of transduced CD19 CAR T cells and in HEK-293 cells, respectively.

DETAILED DESCRIPTION

Figure 1B:
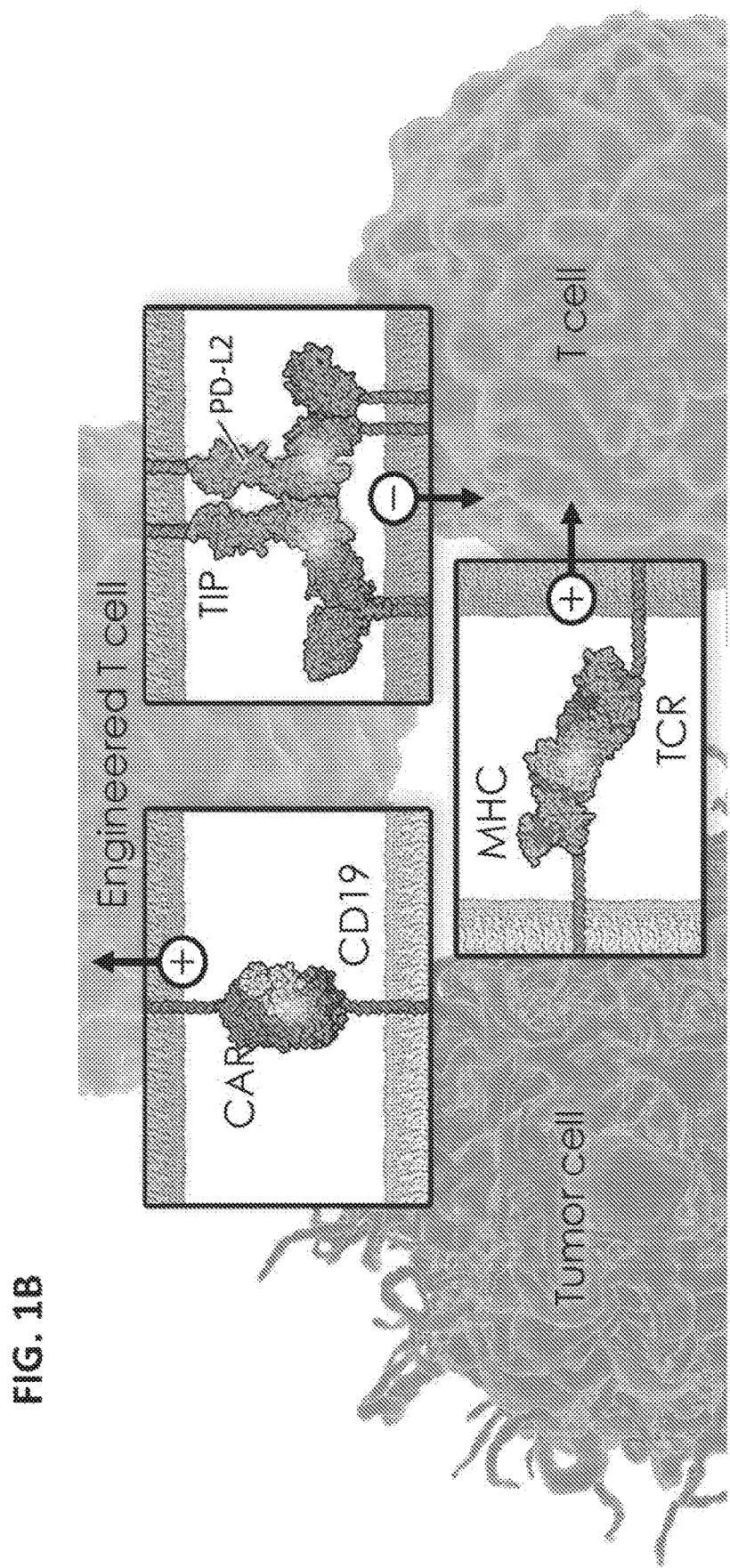
Figure 1C:
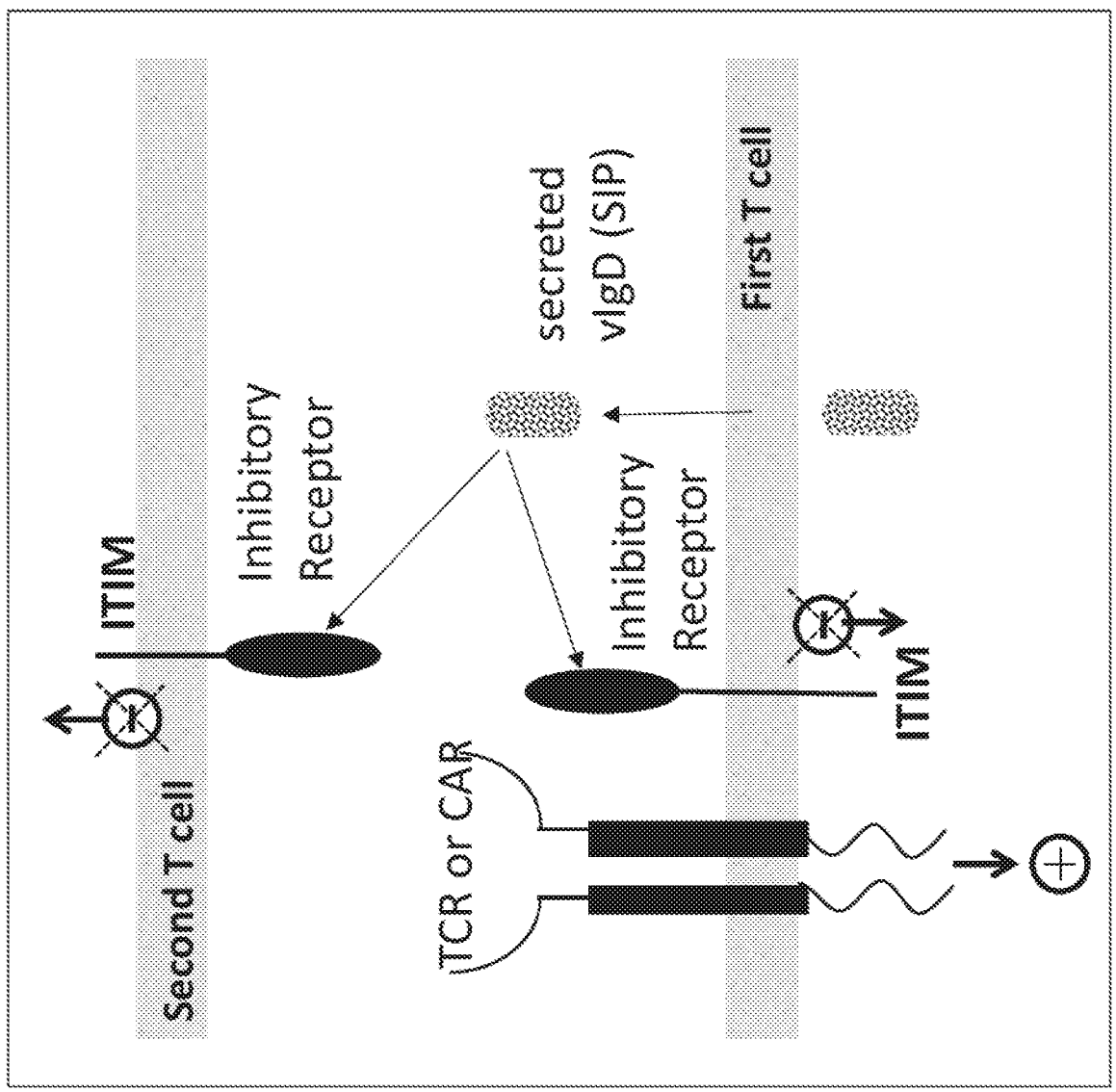
Figure 2:
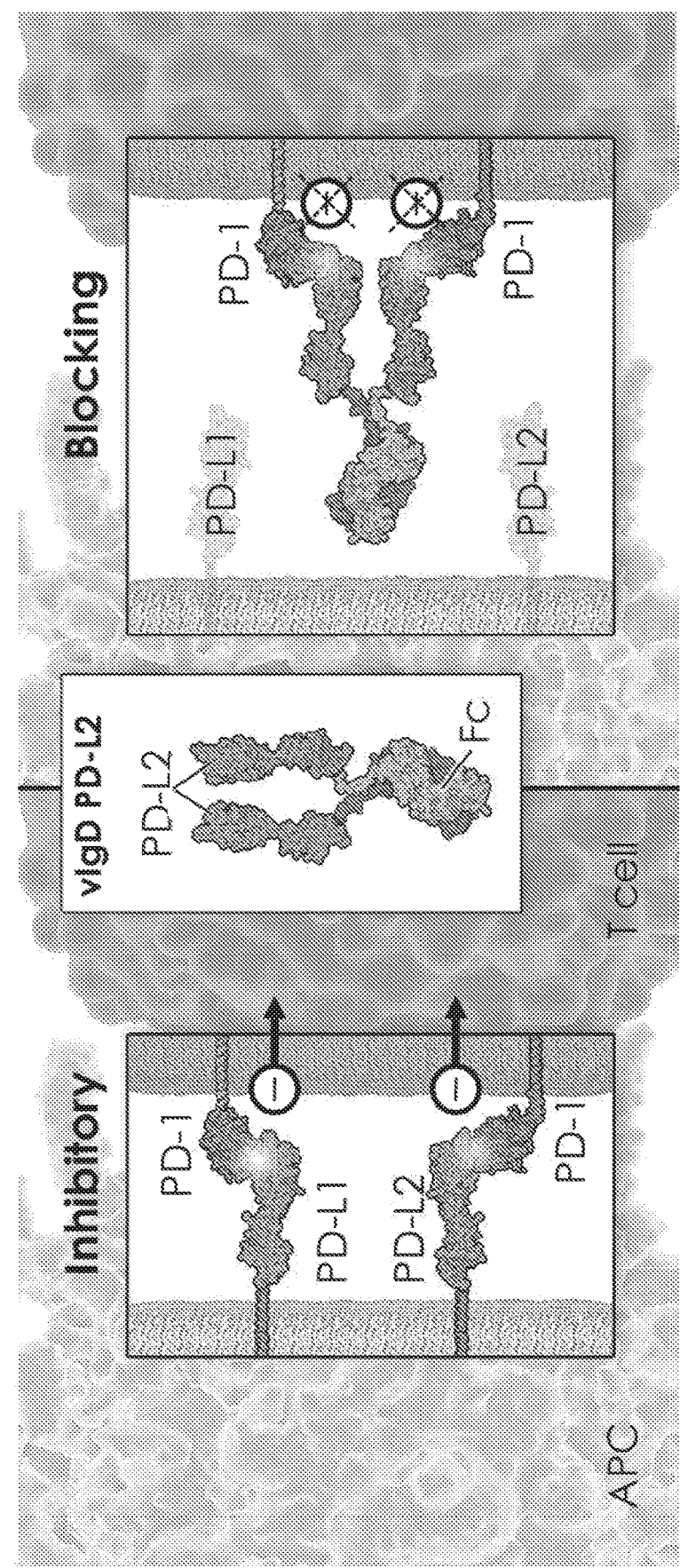
FIG. 2 depicts an exemplary schematic of the activity of a variant IgSF domain (vIgD) fused to an Fc (vIgD-Fc) in which the vIgD is a variant of an IgSF domain of PD-L2. As shown, a soluble vIgD of PD-L2 interacts with its cognate binding partners to block interactions of PD-L1 or PD-L2 with PD-1, thereby blocking the PD-1 inhibitory receptor, and, in some cases, allowing the T cell to differentiate into an effector phenotype.
Figure 3:
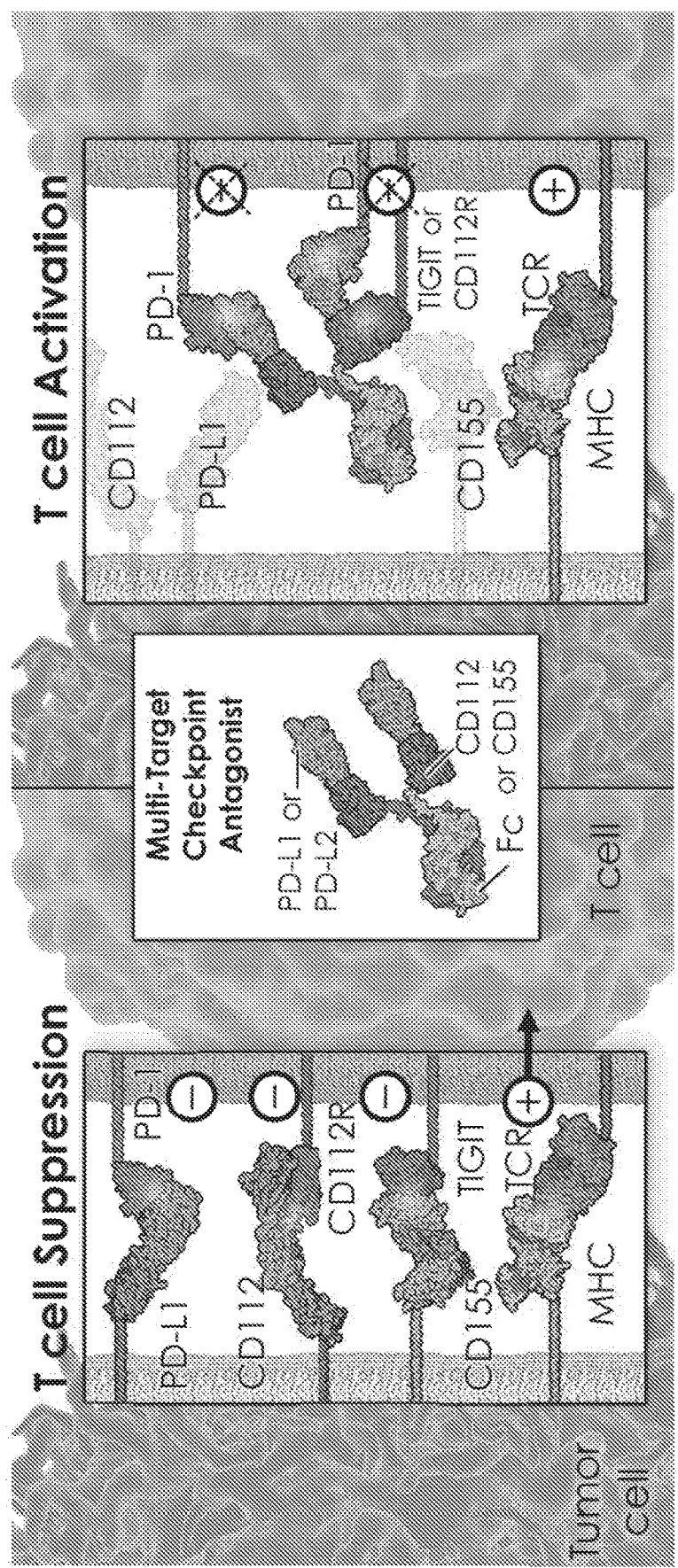
FIG. 3 depicts an exemplary schematic of a stack molecule that is a multi-target checkpoint antagonist containing a first variant IgSF domain (first vIgD) that is a PD-L1 or PD-L2 vIgD and a second IgSF domain (e.g. a second vIgD) that binds to a second inhibitory receptor. In the exemplary schematic, the second IgSF domain (e.g. second vIgD) is a CD112 or CD155 vIgD. As shown, the first vIgD and second vIgD interact with their cognate binding partners to block interactions of PD-L1 or PD-L2 with PD-1 and block interactions of CD155 or CD112 with TIGIT and/or CD112R, respectively, thereby blocking multiple inhibitory receptors.
Figure 4:
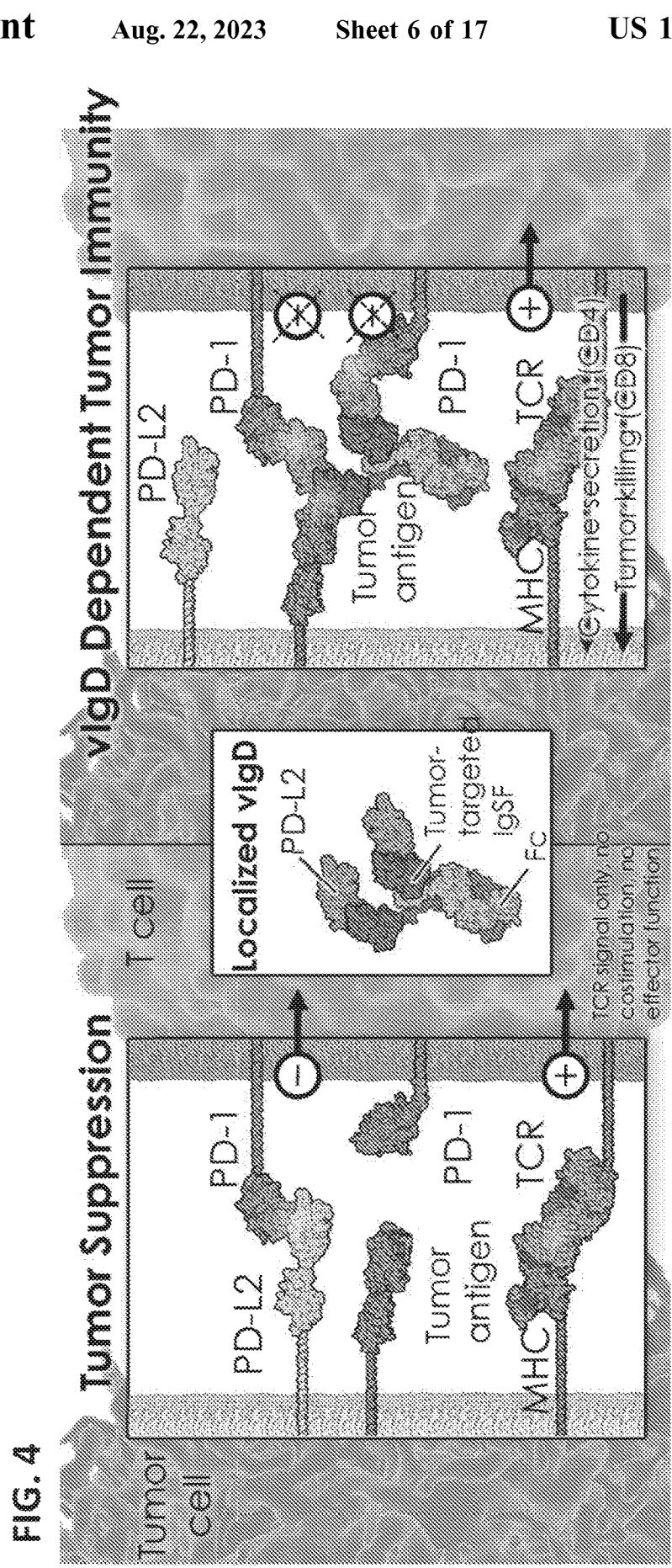
FIG. 4 depicts an exemplary schematic of a stack molecule for localizing the variant IgSF (vIgD) to a tumor cell. In this format, the stack molecule contains a first variant IgSF domain (first vIgD) and a second IgSF domain (e.g. a second vIgD) in which the second IgSF domain (e.g a second vIgD) is a tumor-targeted IgSF domain that binds to a tumor antigen. An exemplary tumor-targeted IgSF domain is an IgSF domain of NKp30, which binds to the tumor antigen B7-H6. In this depiction, the first variant IgSF domain (vIgD) is a variant of an IgSF domain of PD-L2. As shown, binding of tumor-targeted IgSF domain to the surface of the tumor cell localizes the first variant IgSF domain on the tumor cell surface where it can interact with one or more of its cognate binding partners expressed on the surface of an adjacent immune cell (e.g. T cell) to antagonize inhibitory receptor signaling.

Provided herein are immunomodulatory proteins that are or comprise variants or mutants of Programmed cell death 1 ligand 2 (also known as PD-L2, PDCD1L2, PDCD1LG2, cluster of differentiation 273, CD273, or B7-DC) or specific binding fragments thereof that exhibit activity to bind to at least one target ligand cognate binding partner (also called counter-structure protein). In some embodiments, the variant PD-L2 polypeptides contain one or more amino acid modifications (e.g. amino acid substitutions, deletions or additions) compared to an unmodified or wild-type PD-L2 polypeptide. In some embodiments, the one or more amino acid modifications (e.g. substitutions) are in an IgSF domain (e.g. IgV) of an unmodified or wild-type PD-L2 polypeptide. In some embodiments, the variant PD-L2 polypeptide and immunomodulatory proteins exhibits altered, such as increased or decreased, binding activity or affinity for at least one cognate binding partner, such as at least one of PD-1 or RGMb. In some embodiments, the immunomodulatory proteins are soluble. In some embodiments, the immunomodulatory proteins are transmembrane immunomodulatory proteins capable of being expressed on the surface of cells. In some embodiments, also provided herein are one or more other immunomodulatory proteins that are conjugates or fusions containing a variant PD-L2 polypeptide provided herein and one or more other moiety or polypeptide.

In some embodiments, the variant PD-L2 polypeptides and immunomodulatory proteins modulate an immunological immune response, such as increase or decrease an immune response. In some embodiments, the variant PD-L2 polypeptides and immunomodulatory proteins provided herein can be used for the treatment of diseases or conditions that are associated with a dysregulated immune response.

In some embodiments, the provided variant PD-L2 polypeptides modulate T cell activation via interactions with costimulatory and/or coinhibitory signaling molecules. In general, antigen specific T-cell activation generally requires two distinct signals. The first signal is provided by the interaction of the T-cell receptor (TCR) with major histocompatibility complex (MHC) associated antigens present on antigen presenting cells (APCs). The second signal is costimulatory to TCR engagement and is necessary for T cell proliferation, differentiation and/or survival, including, in some cases, to avoid T-cell apoptosis or anergy.

In some embodiments, under normal physiological conditions, the T cell-mediated immune response is initiated by antigen recognition by the T cell receptor (TCR) and is regulated by a balance of co-stimulatory and inhibitory signals (e.g., immune checkpoint proteins). The immune system relies on immune checkpoints to prevent autoimmunity (i.e., self-tolerance) and to protect tissues from excessive damage during an immune response, for example during an attack against a pathogenic infection. In some cases, however, these immunomodulatory proteins can be dysregulated in diseases and conditions, including tumors, as a mechanism for evading the immune system.

In some embodiments, among known T-cell costimulatory receptors is Programmed cell death protein 1 or PD-1, which is the T-cell costimulatory receptor for the ligands PD-L1 (also known as cluster of differentiation 274, CD274. B7 homolog 1 or B7-H1) and PD-L2 (also known as PDCD1L2, PDCD1LG2, cluster of differentiation 273, CD273. or B7-DC). PD-L1 and PD-L2 are normally expressed on the surface of T cells, B cells, and myeloid cells. PD-L1 and PD-L2 are negative regulators of immune activation and are capable of down-modulating the immune response via interactions with programmed death 1 (PD-1) receptor. In some aspects, PD-1 is expressed on NK cells and T cells, including CD4+ and CD8+ T cells, whereby engagement of PD-1 can inhibit activation cell activation, proliferation, and/or expansion. However, PD-L2 ligands can also bind to Repulsive guidance molecule B or RGMb (also known as DRAGON or DRG11-responsive axonal guidance and outgrowth of neurite). The binding of PD-L2 to RGMb can block the interaction between PD-L2 and PD-1, and thereby potentiate or enhance the immune response. Thus, in some cases, interaction of PD-L2 with RGMb and PD-L2 with PD-1 yields opposing effects in modulating immune responses. Thus, PD-1 and RGMb may play opposing roles in immune responses to modulate pro-inflammatory or anti-inflammatory response, which, in some cases, are associated with a number of diseases and conditions.

In some embodiments, PD-1 and RGBb may play complementary roles in modeling an immune response. In some embodiments, enhancement or suppression of the activity of PD-1 receptor has clinical significance for treatment of inflammatory and autoimmune disorders, cancer, and viral infections. In some cases, however, therapies to intervene and alter the immunomodulatory effects of such receptors are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. In addition, in some cases, existing therapeutic drugs may only have the ability to antagonize but not agonize an immune response. Additionally, pharmacokinetic differences between drugs that independently target one of these receptors can create difficulties in properly maintaining a desired blood concentration of such drug combinations throughout the course of treatment.

In some embodiments, the provided variant PD-L2 polypeptides or immunomodulatory proteins modulate (e.g. increase or decrease) immunological activity associated PD-1. Thus, in some embodiments, the provided polypeptides overcome these constraints by providing variant PD-L2 with altered (e.g. increased or decreased) binding affinities to PD-1, thereby agonizing or antagonizing the effects of the receptor. In some embodiments, the provided polypeptides overcome these constraints by providing variant PD-L2 with altered (e.g. increased or decreased) binding affinities to RGMb, thereby modulating the effects of the interaction between PD-1 and PD-L2. Methods of making and using these variant PD-L2 are also provided.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms used throughout this specification are defined as follows unless otherwise limited in specific instances. As used in the specification and the appended claims, the singular forms "a," "an," and "the" include plural referents unless the context clearly dictates otherwise. Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names is per IUPAC-IUB nomenclature. Unless indicated otherwise, all numerical ranges are inclusive of the values defining the range as well as all integer values in-between.

The term "affinity modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding affinity or avidity to at least one of its cognate binding partners (alternatively "counter-structures") compared to the parental wild-type or unmodified (i.e., non-affinity modified) IgSF control domain. Included in this context is an affinity modified PD-L2 IgSF domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a wildtype or unmodified IgSF domain. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1(9): 793-801 (1994). An increase in a protein's binding affinity or avidity to its cognate binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding affinity or avidity to at least one of its cognate binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value. An affinity-modified protein is altered in primary amino acid sequence by substitution, addition, or deletion of amino acid residues. The term "affinity modified IgSF domain" is not to be construed as imposing any condition for any particular starting composition or method by which the affinity-modified IgSF domain was created. Thus, the affinity modified IgSF domains of the present invention are not limited to wild type IgSF domains that are then transformed to an affinity modified IgSF domain by any particular process of affinity modification. An affinity modified IgSF domain polypeptide can, for example, be generated starting from wild type mammalian IgSF domain sequence information, then modeled in silico for binding to its cognate binding partner, and finally recombinantly or chemically synthesized to yield the affinity modified IgSF domain composition of matter. In but one alternative example, an affinity modified IgSF domain can be created by site-directed mutagenesis of a wild-type IgSF domain. Thus, affinity modified IgSF domain denotes a product and not necessarily a product produced by any given process. A variety of techniques including recombinant methods, chemical synthesis, or combinations thereof, may be employed.

The term "allogeneic" as used herein means a cell or tissue that is removed from one organism and then infused or adoptively transferred into a genetically dissimilar organism of the same species. In some embodiments of the invention, the species is murine or human.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which is removed from the organism. For example, a native autologous T-cell can be genetically engineered by recombinant DNA techniques to become an autologous engineered cell expressing a transmembrane immunomodulatory protein and/or chimeric antigen receptor (CAR), which in some cases involves engineering a T-cell or TIL (tumor infiltrating lymphocyte). The engineered cells are then infused into a patient from which the native T-cell was isolated. In some embodiments, the organism is human or murine.

The terms "binding affinity," and "binding avidity" as used herein means the specific binding affinity and specific binding avidity, respectively, of a protein for its counter-structure under specific binding conditions. In biochemical kinetics avidity refers to the accumulated strength of multiple affinities of individual non-covalent binding interactions, such as between PD-L2 and its counter-structures PD-1 and/or RGMb. As such, avidity is distinct from affinity, which describes the strength of a single interaction. An increase or attenuation in binding affinity of a variant PD-L2 containing an affinity modified PD-L2 IgSF domain to its counter-structure is determined relative to the binding affinity of the unmodified PD-L2, such as an unmodified PD-L2 containing the native or wild-type IgSF domain, such as IgV domain. Methods for determining binding affinity or avidity are known in art. See, for example, Larsen et al., American Journal of Transplantation, Vol 5: 443-453 (2005). In some embodiments, a variant PD-L2 of the invention (i.e. a PD-L2 protein containing an affinity modified IgSF domain) specifically binds to PD-1 and/or RGMb measured by flow cytometry with a binding affinity that yields a Mean Fluorescence Intensity (MFI) value at least 10%, 20%, 30%, 40%, 50%, 60%, 70%, 80%, 90%, or 100% greater than a wild-type PD-L2 control in a binding assay.

The term "biological half-life" refers to the amount of time it takes for a substance, such as an immunomodulatory polypeptide comprising a variant PD-L2 of the present invention, to lose half of its pharmacologic or physiologic activity or concentration. Biological half-life can be affected by elimination, excretion, degradation (e.g., enzymatic) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of polypeptides of the invention are known in the art and include, but are not limited to, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), polyglutamic acid (glutamylation).

The term "chimeric antigen receptor" or "CAR" as used herein refers to an artificial (i.e., man-made) transmembrane protein expressed on a mammalian cell comprising at least an ectodomain, a transmembrane, and an endodomain. Optionally, the CAR protein includes a "spacer" which covalently links the ectodomain to the transmembrane domain. A spacer is often a polypeptide linking the ectodomain to the transmembrane domain via peptide bonds. The CAR is typically expressed on a mammalian lymphocyte. In some embodiments, the CAR is expressed on a mammalian cell such as a T-cell or a tumor infiltrating lymphocyte (TIL). A CAR expressed on a T-cell is referred to herein as a "CAR T-cell" or "CAR-T." In some embodiments the CAR-T is a T helper cell, a cytotoxic T-cell, a natural killer T-cell, a memory T-cell, a regulatory T-cell, or a gamma delta T-cell. When used clinically in, e.g. adoptive cell transfer, a CAR-T with antigen binding specificity to the patient's tumor is typically engineered to express on a T-cell obtained from the patient. The engineered T-cell expressing the CAR is then infused back into the patient. The CAR-T is thus often an autologous CAR-T although allogeneic CAR-T are included within the scope of the invention. The ectodomain of a CAR comprises an antigen binding region, such as an antibody or antigen binding fragment thereof (e.g. scFv), that specifically binds under physiological conditions with a target antigen, such as a tumor specific antigen. Upon specific binding a biochemical chain of events (i.e., signal transduction) results in modulation of the immunological activity of the CAR-T. Thus, for example, upon specific binding by the antigen binding region of the CAR-T to its target antigen can lead to changes in the immunological activity of the T-cell activity as reflected by changes in cytotoxicity, proliferation or cytokine production. Signal transduction upon CAR-T activation is achieved in some embodiments by the CD3-zeta chain ("CD3-z") which is involved in signal transduction in native mammalian T-cells. CAR-Ts can further comprise multiple signaling domains such as CD28, 41BB or OX40, to further modulate immunomodulatory response of the T-cell. CD3-z comprises a conserved motif known as an immunoreceptor tyrosine-based activation motif (ITAM) which is involved in T-cell receptor signal transduction.

The term "collectively" or "collective" when used in reference to cytokine production induced by the presence of two or more variant PD-L2 of the invention in an in vitro assay, means the overall cytokine expression level irrespective of the cytokine production induced by individual variant PD-L2. In some embodiments, the cytokine being assayed is IFN-gamma, such as in an in vitro primary T-cell assay.

The term "cognate binding partner" (used interchangeably with "counter-structure") in reference to a polypeptide, such as in reference to an IgSF domain of a variant PD-L2, refers to at least one molecule (typically a native mammalian protein) to which the referenced polypeptide specifically binds under specific binding conditions. In some aspects, a variant PD-L2 containing an affinity modified IgSF domain specifically binds to the counter-structure of the corresponding native or wildtype PD-L2 but with increased or attenuated affinity. A species of ligand recognized and specifically binding to its cognate receptor under specific binding conditions is an example of a counter-structure or cognate binding partner of that receptor. A "cognate cell surface binding partner" is a cognate binding partner expressed on a mammalian cell surface. A "cell surface molecular species" is a cognate binding partner of ligands of the immunological synapse (IS), expressed on and by cells, such as mammalian cells, forming the immunological synapse.

As used herein, "conjugate," "conjugation" or grammatical variations thereof refers the joining or linking together of two or more compounds resulting in the formation of another compound, by any joining or linking methods known in the art. It can also refer to a compound which is generated by the joining or linking together two or more compounds. For example, a variant PD-L2 polypeptide linked directly or indirectly to one or more chemical moieties or polypeptide is an exemplary conjugate. Such conjugates include fusion proteins, those produced by chemical conjugates and those produced by any other methods.

The term "competitive binding" as used herein means that a protein is capable of specifically binding to at least two cognate binding partners but that specific binding of one cognate binding partner inhibits, such as prevents or precludes, simultaneous binding of the second cognate binding partner. Thus, in some cases, it is not possible for a protein to bind the two cognate binding partners at the same time. Generally, competitive binders contain the same or overlapping binding site for specific binding but this is not a requirement. In some embodiments, competitive binding causes a measurable inhibition (partial or complete) of specific binding of a protein to one of its cognate binding partner due to specific binding of a second cognate binding partner. A variety of methods are known to quantify competitive binding such as ELISA (enzyme linked immunosorbent assay) assays.

The term "conservative amino acid substitution" as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, "corresponding to" with reference to positions of a protein, such as recitation that nucleotides or amino acid positions "correspond to" nucleotides or amino acid positions in a disclosed sequence, such as set forth in the Sequence listing, refers to nucleotides or amino acid positions identified upon alignment with the disclosed sequence based on structural sequence alignment or using a standard alignment algorithm, such as the GAP algorithm. For example, corresponding residues can be determined by alignment of a reference sequence with the sequence of wild-type PD-L2 set forth in SEQ ID NO:31 (ECD domain) or set forth in SEQ ID NO: 55 (IgV domain) by structural alignment methods as described herein. By aligning the sequences, one skilled in the art can identify corresponding residues, for example, using conserved and identical amino acid residues as guides.

The terms "decrease" or "attenuate" "or suppress" as used herein means to decrease by a statistically significant amount. A decrease can be at least 10%, 20%, 30%, 40%, 50%, 60%, 70%, 80%, 90%, or 100%.

The terms "derivatives" or "derivatized" refer to modification of a protein by covalently linking it, directly or indirectly, to a composition so as to alter such characteristics as biological half-life, bioavailability, immunogenicity, solubility, toxicity, potency, or efficacy while retaining or enhancing its therapeutic benefit. Derivatives of immunomodulatory polypeptides of the invention are within the scope of the invention and can be made by, for example, glycosylation, pegylation, lipidation, or Fc-fusion.

As used herein, "domain" (typically a sequence of three or more, generally 5 or 7 or more amino acids, such as 10 to 200 amino acid residues) refers to a portion of a molecule, such as a protein or encoding nucleic acid, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a cognate binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

The term "ectodomain" as used herein refers to the region of a membrane protein, such as a transmembrane protein, that lies outside the vesicular membrane. Ectodomains often comprise binding domains that specifically bind to ligands or cell surface receptors, such as via a binding domain that specifically binds to the ligand or cell surface receptor. The ectodomain of a cellular transmembrane protein is alternately referred to as an extracellular domain.

The terms "effective amount" or "therapeutically effective amount" refer to a quantity and/or concentration of a therapeutic composition of the invention, including a protein composition or cell composition, that when administered ex vivo (by contact with a cell from a patient) or in vivo (by administration into a patient) either alone (i.e., as a monotherapy) or in combination with additional therapeutic agents, yields a statistically significant decrease in disease progression as, for example, by ameliorating or eliminating symptoms and/or the cause of the disease. An effective amount may be an amount that relieves, lessens, or alleviates at least one symptom or biological response or effect associated with a disease or disorder, prevents progression of the disease or disorder, or improves physical functioning of the patient. In the case of cell therapy, the effective amount is an effective dose or number of cells administered to a patient by adoptive cell therapy. In some embodiments the patient is a mammal such as a non-human primate or human patient.

The term "endodomain" as used herein refers to the region found in some membrane proteins, such as transmembrane proteins, that extends into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain.

The terms "enhanced" or "increased" as used herein in the context of increasing immunological activity of a mammalian lymphocyte means to increase one or more activities the lymphocyte. An increased activity can be one or more of increase cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a non-zero control value.

The term "engineered cell" as used herein refers to a mammalian cell that has been genetically modified by human intervention such as by recombinant DNA methods or viral transduction. In some embodiments, the cell is an immune cell, such as a lymphocyte (e.g. T cell, B cell, NK cell) or an antigen presenting cell (e.g. dendritic cell). The cell can be a primary cell from a patient or can be a cell line. In some embodiments, an engineered cell of the invention comprises a variant PD-L2 of the invention engineered to modulate immunological activity of a T-cell expressing PD-1 and/or RGMb to which the variant PD-L2 specifically binds. In some embodiments, the variant PD-L2 is a transmembrane immunomodulatory protein (hereinafter referred to as "TIP") containing the extracellular domain or a portion thereof containing the IgV domain linked to a transmembrane domain (e.g. a PD-L2 transmembrane domain) and, optionally, an intracellular signaling domain. In some cases, the TIP is formatted as a chimeric receptor containing a heterologous cytoplasmic signaling domain or endodomain. In some embodiments, an engineered cell is capable of expressing and secreting an immunomodulatory protein as described herein. Among provided engineered cells also are cells further containing an engineered T-cell receptor (TCR) or chimeric antigen receptor (CAR).

The term "engineered T-cell" as used herein refers to a T-cell such as a T helper cell, cytotoxic T-cell (alternatively, cytotoxic T lymphocyte or CTL), natural killer T-cell, regulatory T-cell, memory T-cell, or gamma delta T-cell, that has been genetically modified by human intervention such as by recombinant DNA methods or viral transduction methods. An engineered T-cell comprises a variant PD-L2 transmembrane immunomodulatory protein (TIP) or secreted immunodulatory protein (SIP) of the present invention that is expressed on the T-cell and is engineered to modulate immunological activity of the engineered T-cell itself, or a mammalian cell to which the variant PD-L2 expressed on the T-cell specifically binds.

The term "engineered T-cell receptor" or "engineered TCR" refers to a T-cell receptor (TCR) engineered to specifically bind with a desired affinity to a major histocompatibility complex (MHC)/peptide target antigen that is selected, cloned, and/or subsequently introduced into a population of T-cells, often used for adoptive immunotherapy. In contrast to engineered TCRs, CARs are engineered to bind target antigens in a MHC independent manner.

The term "expressed on" as used herein is used in reference to a protein expressed on the surface of a cell, such as a mammalian cell. Thus, the protein is expressed as a membrane protein. In some embodiments, the expressed protein is a transmembrane protein. In some embodiments, the protein is conjugated to a small molecule moiety such as a drug or detectable label. Proteins expressed on the surface of a cell can include cell-surface proteins such as cell surface receptors that are expressed on mammalian cells.

The term "half-life extending moiety" refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), and polyglutamic acid (glutamylation).

The term "immunological synapse" or "immune synapse" as used herein means the interface between a mammalian cell that expresses MHC I (major histocompatibility complex) or MHC II, such as an antigen-presenting cell or tumor cell, and a mammalian lymphocyte such as an effector T cell or Natural Killer (NK) cell.

An Fc (fragment crystallizable) region or domain of an immunoglobulin molecule (also termed an Fc polypeptide) corresponds largely to the constant region of the immunoglobulin heavy chain, and is responsible for various functions, including the antibody's effector function(s). The Fc domain contains part or all of a hinge domain of an immunoglobulin molecule plus a CH2 and a CH3 domain. The Fc domain can form a dimer of two polypeptide chains joined by one or more disulfide bonds. In some embodiments, the Fc is a variant Fc that exhibits reduced (e.g. reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics information system®, www.imgt.org/IMGTScientificChart/Numbering/Hu_IGHGnber.html (created: 17 May 2001, last updated: 10 Jan. 2013) and the EU index as reported in Kabat, E. A. et al. Sequences of Proteins of Immunological interest. 5th ed. US Department of Health and Human Services, NIH publication No. 91-3242 (1991).

An immunoglobulin Fc fusion ("Fc-fusion"), such as an immunomodulatory Fc fusion protein, is a molecule comprising one or more polypeptides (or one or more small molecules) operably linked to an Fc region of an immunoglobulin. An Fc-fusion may comprise, for example, the Fc region of an antibody (which facilitates effector functions and pharmacokinetics) and a variant PD-L2. An immunoglobulin Fc region may be linked indirectly or directly to one or more variant PD-L2 or small molecules (fusion partners). Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine or human Fc.

The term "host cell" refers to a cell that can be used to express a protein encoded by a recombinant expression vector. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO and related cell lines which grow in serum-free media or CHO strain DX-B11, which is deficient in DHFR. Another example is Human Endothelial Kidney 293 cells or their derivatives. In some embodiments, a host cell is a mammalian cell (e.g., a human cell, a monkey cell, a hamster cell, a rat cell, a mouse cell, or an insect cell).

The term "immunoglobulin" (abbreviated "Ig") as used herein refers to a mammalian immunoglobulin protein including any of the five human classes of antibody: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, such as antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', F(ab)$_2$, F(ab')$_2$, dsFv diabody, Fc, and Fd polypeptide fragments. Bispecific antibodies, homobispecific and heterobispecific, are included within the meaning of the term.

The term "immunoglobulin superfamily" or "IgSF" as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into "subfamilies" based on shared properties such as function. Such subfamilies typically consist of from 4 to 30 IgSF members.

The terms "IgSF domain" or "immunoglobulin domain" or "Ig domain" as used herein refers to a structural domain of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands, stabilize the Ig-fold. One end of the Ig domain has a section called the complementarity determining region that is important for the specificity of antibodies for their ligands. The Ig like domains can be classified (into classes) as: IgV, IgC (which either can be an IgC1 or IgC2), or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. PD-L2 contains two Ig domains: one IgV and one IgC domain.

The term "IgSF species" as used herein means an ensemble of IgSF member proteins with identical or substantially identical primary amino acid sequence. Each mammalian immunoglobulin superfamily (IgSF) member defines a unique identity of all IgSF species that belong to that IgSF member. Thus, each IgSF family member is unique from other IgSF family members and, accordingly, each species of a particular IgSF family member is unique from the species of another IgSF family member. Nevertheless, variation between molecules that are of the same IgSF species may occur owing to differences in post-translational modification such as glycosylation, phosphorylation, ubiquitination, nitrosylation, methylation, acetylation, and lipidation. Additionally, minor sequence differences within a single IgSF species owing to gene polymorphisms constitute another form of variation within a single IgSF species as do wild type truncated forms of IgSF species owing to, for example, proteolytic cleavage. A "cell surface IgSF species" is an IgSF species expressed on the surface of a cell, generally a mammalian cell.

The term "immunological activity" as used herein in the context of mammalian lymphocytes such as T-cells refers to one or more cell survival, cell proliferation, cytokine production (e.g. interferon-gamma), or T-cell cytotoxicity activities. In some cases, an immunological activity can mean the cell expression of cytokines, such as chemokines or interleukins. Assays for determining enhancement or suppression of immunological activity include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104). Since T cell activation is associated with secretion of IFN-gamma cytokine, detecting IFN-gamma levels in culture supernatants from these in vitro human T cell assays can be assayed using commercial ELISA kits (Wu et al, Immunol Lett 2008 Apr. 15; 117(1): 57-62). Induction of an immune response results in an increase in immunological activity relative to quiescent lymphocytes. An immunomodulatory protein, such as a variant PD-L2 polypeptide containing an affinity modified IgSF domain, as provided herein can in some embodiments increase or, in alternative embodiments, decrease IFN-gamma (interferon-gamma) expression in a primary T-cell assay relative to a wild-type IgSF member or IgSF domain control. Those of skill will recognize that the format of the primary T-cell assay used to determine an increase in IFN-gamma expression can differ from that employed to assay for a decrease in IFN-gamma expression. In assaying for the ability of an immunomodulatory protein or affinity modified IgSF domain of the invention to alter IFN-gamma expression in a primary T-cell assay, a Mixed Lymphocyte Reaction (MLR) assay can be used. Conveniently, in some cases, a soluble form of an affinity modified IgSF domain of the invention can be employed to determine its ability to increase or decrease the IFN-gamma expression in a MLR. Alternatively, a co-immobilization assay can be used. In a co-immobilization assay, a T-cell receptor signal, provided in some embodiments by anti-CD3 antibody, is used in conjunction with a co-immobilized affinity modified IgSF domain, such as variant PD-L2, to determine the ability to increase or decrease IFN-gamma expression relative to a wild-type IgSF domain control. Methods to assay the immunological activity of engineered cells, including to evaluate the activity of a variant PD-L2 transmembrane immunomodulatory protein, are known in the art and include, but are not limited to, the ability to expand T cells following antigen stimulation, sustain T cell expansion in the absence of re-stimulation, and anti-cancer activities in appropriate animal models. Assays also include assays to assess cytotoxicity, including a standard $^{51}$Cr-release assay (see e.g. Milone et al., (2009) Molecular Therapy 17: 1453-1464) or flow based cytotoxicity assays, or an impedance based cytotoxicity assay (Peper et al. (2014) Journal of Immunological Methods, 405:192-198).

An "immunomodulatory polypeptide" or "immunomodulatory protein" is a polypeptide or protein molecule that modulates immunological activity. By "modulation" or "modulating" an immune response is meant that immunological activity is either increased or decreased. An immunomodulatory protein can be a single polypeptide chain or a multimer (dimers or higher order multimers) of at least two polypeptide chains covalently bonded to each other by, for example, interchain disulfide bonds. Thus, monomeric, dimeric, and higher order multimeric polypeptides are within the scope of the defined term. Multimeric polypeptides can be homomultimeric (of identical polypeptide chains) or heteromultimeric (of non-identical polypeptide chains). An immunomodulatory protein of the invention comprises a variant PD-L2.

The term "increase" as used herein means to increase by a statistically significant amount. An increase can be at least 5%, 10%, 20%, 30%, 40%, 50%, 75%, 100%, or greater than a non-zero control value.

An "isoform" of PD-L2 is one of a plurality naturally occurring PD-L2 polypeptides that differ in amino acid sequence. Isoforms can be the product of splice variants of an RNA transcript expressed by a single gene, or the expression product of highly similar but different genes yielding a functionally similar protein such as may occur from gene duplication. As used herein, the term "isoform" of PD-L2 also refers to the product of different alleles of a PD-L2 gene.

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an "integral monotopic protein". An integral membrane protein that interacts with both lipid bilayers is an "integral polytopic protein" alternatively referred to herein as a "transmembrane protein".

The terms "modulating" or "modulate" as used herein in the context of an immune response, such as a mammalian immune response, refer to any alteration, such as an increase or a decrease, of existing or potential immune responses that occurs as a result of administration of an immunomodulatory polypeptide comprising a variant PD-L2 of the present invention or as a result of administration of engineered cells expresses an immunomodulatory protein, such as a variant PD-L2 transmembrane immunomodulatory protein of the present invention. Thus, it refers to an alteration, such as an increase or decrease, of an immune response as compared to the immune response that occurs or is present in the absence of the administration of the immunomodulatory protein comprising the variant PD-L2 or cells expressing such an immunomodulatory polypeptide. Such modulation includes any induction, activation, suppression or alteration in degree or extent of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils). Modulation includes any change imparted on an existing immune response, a developing immune response, a potential immune response, or the capacity to induce, regulate, influence, or respond to an immune response. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; induction or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, growth factors, transcription factors, kinases, costimulatory molecules, or other cell surface receptors or any combination of these modulatory events. Modulation can be assessed, for example, by an alteration in IFN-gamma (interferon gamma) expression relative to the wild-type PD-L2 control in a primary T cell assay (see, Zhao and Ji, Exp Cell Res. 2016 Jan. 1; 340(1) 132-138). Modulation can be assessed, for example, by an alteration of an immunological activity of engineered cells, such as an alteration in in cytotoxic activity of engineered cells or an alteration in cytokine secretion of engineered cells relative to cells engineered with a wild-type PD-L2 transmembrane protein The term "molecular species" as used herein means an ensemble of proteins with identical or substantially identical primary amino acid sequence. Each mammalian immunoglobulin superfamily (IgSF) member defines a collection of identical or substantially identical molecular species. Thus, for example, human PD-L2 is an IgSF member and each human PD-L2 molecule is a molecular species of PD-L2. Variation between molecules that are of the same molecular species may occur owing to differences in post-translational modification such as glycosylation, phosphorylation, ubiquitination, nitrosylation, methylation, acetylation, and lipidation. Additionally, minor sequence differences within a single molecular species owing to gene polymorphisms constitute another form of variation within a single molecular species as do wild type truncated forms of a single molecular species owing to, for example, proteolytic cleavage. A "cell surface molecular species" is a molecular species expressed on the surface of a mammalian cell. Two or more different species of protein, each of which is present exclusively on one or exclusively the other (but not both) of the two mammalian cells forming the IS, are said to be in "cis" or "cis configuration" with each other. Two different species of protein, the first of which is exclusively present on one of the two mammalian cells forming the IS and the second of which is present exclusively on the second of the two mammalian cells forming the IS, are said to be in "trans" or "trans configuration." Two different species of protein each of which is present on both of the two mammalian cells forming the IS are in both cis and trans configurations on these cells.

The term, a "multimerization domain" refers to a sequence of amino acids that promotes stable interaction of a polypeptide molecule with one or more additional polypeptide molecules, each containing a complementary multimerization domain (e.g. a first multimerization domain and a second multimerization domain), which can be the same or a different multimerization domain. The interactions between complementary multimerization domains, e.g. interaction between a first multimerization domain and a second multimerization domain, form a stable protein-protein interaction to produce a multimer of the polypeptide molecule with the additional polypeptide molecule. In some cases, the multimerization domain is the same and interacts with itself to form a stable protein-protein interaction between two polypeptide chains. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The terms "nucleic acid" and "polynucleotide" are used interchangeably to refer to a polymer of nucleic acid residues (e.g., deoxyribonucleotides or ribonucleotides) in either single- or double-stranded form. Unless specifically limited, the terms encompass nucleic acids containing known analogues of natural nucleotides and that have similar binding properties to it and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated (a "reference sequence"). Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The term "non-competitive binding" as used herein means the ability of a protein to specifically bind simultaneously to at least two cognate binding partners. Thus, the protein is able to bind to at least two different cognate binding partners at the same time, although the binding interaction need not be for the same duration such that, in some cases, the protein is specifically bound to only one of the cognate binding partners. In some embodiments, the binding occurs under specific binding conditions. In some embodiments, the simultaneous binding is such that binding of one cognate binding partner does not substantially inhibit simultaneous binding to a second cognate binding partner. In some embodiments, non-competitive binding means that binding a second cognate binding partner to its binding site on the protein does not displace the binding of a first cognate binding partner to its binding site on the protein. Methods of assessing non-competitive binding are well known in the art such as the method described in Perez de La Lastra et al., Immunology, 1999 April: 96(4): 663-670. In some cases, in non-competitive interactions, the first cognate binding partner specifically binds at an interaction site that does not overlap with the interaction site of the second cognate binding partner such that binding of the second cognate binding partner does not directly interfere with the binding of the first cognate binding partner. Thus, any effect on binding of the cognate binding partner by the binding of the second cognate binding partner is through a mechanism other than direct interference with the binding of the first cognate binding partner. For example, in the context of enzyme-substrate interactions, a non-competitive inhibitor binds to a site other than the active site of the enzyme. Non-competitive binding encompasses uncompetitive binding interactions in which a second cognate binding partner specifically binds at an interaction site that does not overlap with the binding of the first cognate binding partner but binds to the second interaction site only when the first interaction site is occupied by the first cognate binding partner.

The term "pharmaceutical composition" refers to a composition suitable for pharmaceutical use in a mammalian subject, often a human. A pharmaceutical composition typically comprises an effective amount of an active agent (e.g., an immunomodulatory polypeptide comprising a variant PD-L2 or engineered cells expressing a variant PD-L2 transmembrane immunomodulatory protein) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylations, acetylations, phosphorylations and the like. The terms also include molecules in which one or more amino acid analogs or non-canonical or unnatural amino acids are included as can be synthesized, or expressed recombinantly using known protein engineering techniques. In addition, proteins can be derivatized.

The term "primary T-cell assay" as used herein refers to an in vitro assay to measure interferon-gamma ("IFN-gamma") expression. A variety of such primary T-cell assays are known in the art. In a preferred embodiment, the assay used is an anti-CD3 coimmobilizaton assay. In this assay, primary T cells are stimulated by anti-CD3 immobilized with or without additional recombinant proteins. Culture supernatants are harvested at timepoints, usually 24-72 hours. In another embodiment, the assay used is the MLR. In this assay, primary T cells are stimulated with allogeneic APC. Culture supernatants are harvested at timepoints, usually 24-72 hours. Human IFN-gamma levels are measured in culture supernatants by standard ELISA techniques. Commercial kits are available from vendors and the assay is performed according to manufacturer's recommendation.

The term "purified" as applied to nucleic acids, such as encoding immunomodulatory proteins of the invention, generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein of the invention is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a transmembrane immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. The terms "in operable combination," "in operable order" and "operably linked" as used herein refer to the linkage of nucleic acid sequences in such a manner or orientation that a nucleic acid molecule capable of directing the transcription of a given gene and/or the synthesis of a desired protein molecule is produced.

The term "recombinant expression vector" as used herein refers to a DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence for the recombinant protein, such as a recombinant fusion protein, so that the expressed fusion protein can be secreted by the recombinant host cell, for easier isolation of the fusion protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one cognate binding partner, compared to specific binding for another substrate, such as a different cognate binding partner of the subject protein. Selectivity can be reflected as a ratio of the binding activity (e.g. binding affinity) of a subject protein and a first substrate, such as a first cognate binding partner, (e.g., $K_{d1}$) and the binding activity (e.g. binding affinity) of the same subject protein with a second cognate binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology information (NCBI) website.

The term "soluble" as used herein in reference to proteins, means that the protein is not a membrane protein. In general, a soluble protein contains only the extracellular domain of an IgSF family member receptor, or a portion thereof containing an IgSF domain or domains or specific-binding fragments thereof, but does not contain the transmembrane domain. In some cases, solubility of a protein can be improved by linkage or attachment, directly or indirectly via a linker, to an Fc domain, which, in some cases, also can improve the stability and/or half-life of the protein. In some aspects, a soluble protein is an Fc fusion protein.

The term "species" as used herein with respect to polypeptides or nucleic acids means an ensemble of molecules with identical or substantially identical sequences. Variation between polypeptides that are of the same species may occur owing to differences in post-translational modification such as glycosylation, phosphorylation, ubiquitination, nitrosylation, methylation, acetylation, and lipidation. Slightly truncated sequences of polypeptides that differ (or encode a difference) from the full length species at the amino-terminus or carboxy-terminus by no more than 1, 2, or 3 amino acid residues are considered to be of a single species. Such microheterogeneities are a common feature of manufactured proteins.

The term "specific binding fragment" as used herein in reference to a full-length wild-type mammalian PD-L2 polypeptide or an IgV or an IgC (e.g. IgC2) domain thereof, means a polypeptide having a subsequence of the full-length polypeptide or an IgV and/or IgC domain and that specifically binds in vitro and/or in vivo to a mammalian PD-1 and/or mammalian RGMb such as a human or murine PD-1 or RGMb. In some embodiments, the specific binding fragment comprises an PD-L2 IgV or a PD-L2 IgC2 subsequence that is at least 60%, 70%, 75%, 80%, 85%, 90%, 95%, 96%, 97%, 98%, or 99% the sequence length of the full-length wild-type sequence or an IgV or a an IgC (e.g. IgC2) sequence thereof. The specific binding fragment can be altered in sequence to form a variant PD-L2 of the invention.

The term "specifically binds" as used herein means the ability of a protein, under specific binding conditions, to bind to a target protein such that its affinity or avidity is at least 5 times as great, but optionally at least 10, 20, 30, 40, 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to a non-target molecule due to similarity in structural conformation between the target and non-target (e.g., paralogs or orthologs). Those of skill will recognize that specific binding to a molecule having the same function in a different species of animal (i.e., ortholog) or to a non-target molecule having a substantially similar epitope as the target molecule (e.g., paralog) is possible and does not detract from the specificity of binding which is determined relative to a statistically valid collection of unique non-targets (e.g., random polypeptides). Thus, a polypeptide of the invention may specifically bind to more than one distinct species of target molecule due to cross-reactivity. Solid-phase ELISA immunoassays, ForteBio Octet, or Biacore measurements can be used to determine specific binding between two proteins. Generally, interactions between two binding proteins have dissociation constants ($K_d$) less than $1 \times 10^{-5}$ M, and often as low as $1 \times 10^{-12}$ M. In certain embodiments of the present disclosure, interactions between two binding proteins have dissociation constants of less than or less than about $1 \times 10^{-6}$ M, $1 \times 10^{-7}$ M, $1 \times 10^{-8}$ M, $1 \times 10^{-9}$ M, $1 \times 10^{-10}$ M or $1 \times 10^{-11}$ M or less.

The terms "surface expresses" or "surface expression" in reference to a mammalian cell expressing a polypeptide means that the polypeptide is expressed as a membrane protein. In some embodiments, the membrane protein is a transmembrane protein.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

The term "targeting moiety" as used herein refers to a composition that is covalently or non-covalently attached to, or physically encapsulates, a polypeptide comprising a variant PD-L2 of the present invention. The targeting moiety has specific binding affinity for a desired counter-structure such as a cell sur are cancerous. In other embodiments, at least 60%, 70%, 80%, 85%, 90%, 95%, or 99% of the cells displaying a TSA are cancerous.

The term "variant" (also "modified" or mutant") as used in reference to a variant PD-L2 means a PD-L2, such as a mammalian (e.g., human or murine) PD-L2 created by human intervention. The variant PD-L2 is a polypeptide having an altered amino acid sequence, relative to an unmodified or wild-type PD-L2. The variant PD-L2 is a polypeptide which differs from a wild-type PD-L2 isoform sequence by one or more amino acid substitutions, deletions, additions, or combinations thereof. For purposes herein, the variant PD-L2 contains at least one affinity modified domain, whereby one or more of the amino acid differences occurs in an IgSF domain (e.g. IgV domain). A variant PD-L2 can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant PD-L2 polypeptide generally exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified PD-L2, such as to the sequence of SEQ ID NO:3, a mature sequence thereof (lacking the signal sequence) or a portion thereof containing the extracellular domain or an IgSF domain thereof. In some embodiments, a variant PD-L2 polypeptide exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified PD-L2 comprising the sequence set forth in SEQ ID NO:31 or SEQ ID NO: 55. Non-naturally occurring amino acids as well as naturally occurring amino acids are included within the scope of permissible substitutions or additions. A variant PD-L2 is not limited to any particular method of making and includes, for example, de novo chemical synthesis, de novo recombinant DNA techniques, or combinations thereof. A variant PD-L2 of the invention specifically binds to at least one or more of PD-1 or RGMb of a mammalian species. In some embodiments, the altered amino acid sequence results in an altered (i.e., increased or decreased) binding affinity or avidity to PD-1 and/or RGMb compared to the wild-type or unmodified PD-L2 protein. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1(9): 793-801 (1994). An increase in variant PD-L2 binding affinity or avidity to PD-1 and/or RGMb is to a value at least 5% greater than that of the wild-type or unmodified PD-L2 and in some embodiments, at least 10%, 15%, 20%, 30%, 40%, 50%, 100% greater than that of the wild-type or unmodified PD-L2 control value. A decrease in PD-L2 binding affinity or avidity to PD-1 and/or RGMb is to a value no greater than 95% of the wild-type or unmodified control values, and in some embodiments no greater than 80%, 70% 60%, 50%, 40%, 30%, 20%, 10%, 5%, or no detectable binding affinity or avidity of the wild-type or unmodified control values. A variant PD-L2 is altered in primary amino acid sequence by substitution, addition, or deletion of amino acid residues. The term "variant" in the context of variant PD-L2 is not to be construed as imposing any condition for any particular starting composition or method by which the variant PD-L2 is created. A variant PD-L2 can, for example, be generated starting from wild type mammalian PD-L2 sequence information, then modeled in silico for binding to PD-1 and/or RGMb, and finally recombinantly or chemically synthesized to yield a variant PD-L2 of the present invention. In but one alternative example, a variant PD-L2 can be created by site-directed mutagenesis of a wild-type PD-L2. Thus, variant PD-L2 denotes a composition and not necessarily a product produced by any given process. A variety of techniques including recombinant methods, chemical synthesis, or combinations thereof, may be employed.

The term "wild-type" or "natural" or "native" as used herein is used in connection with biological materials such as nucleic acid molecules, proteins (e.g., PD-L2), IgSF members, host cells, and the like, refers to those which are found in nature and not modified by human intervention.

II. VARIANT PD-L2 POLYPEPTIDES

Provided herein are variant PD-L2 polypeptides that exhibit altered (increased or decreased) binding activity or affinity for one or more of a PD-L2 cognate binding partner. In some embodiments, the PD-L2 cognate binding partner is PD-1 or RGMb. In some embodiments, the PD-L2 cognate binding partner is PD-1. In some embodiments, the variant PD-L2 polypeptide contains one or more amino acids modifications, such as one or more substitutions (alternatively, "mutations" or "replacements"), deletions or addition, in an immunoglobulin superfamily (IgSF) domain (IgD) relative to a wild-type or unmodified PD-L2 polypeptide or a portion of a wild-type or unmodified PD-L2 containing an immunoglobulin superfamily (IgSF) domain or a specific binding fragment thereof. Thus, a provided variant PD-L1 polypeptide is or comprises a variant IgD (hereinafter called "vIgD") in which the one or more amino acid modifications (e.g. substitutions) is in an IgD.

In some embodiments, the IgD comprises an IgV domain or an IgC (e.g. IgC2) domain or specific binding fragment of the IgV domain or the IgC (e.g. IgC2) domain, or combinations thereof. In some embodiments, the IgD can be an IgV only, the combination of the IgV and IgC, including the entire extracellular domain (ECD), or any combination of Ig domains of PD-L2. Table 2 provides exemplary residues that correspond to IgV or IgC regions of PD-L2. In some embodiments, the variant PD-L2 polypeptide contains an IgV domain or an IgC domain or specific binding fragments thereof in which the at least one of the amino acid modifications (e.g. substitutions) is in the IgV domain or IgC domain or a specific binding fragment thereof. In some embodiments, the variant PD-L2 polypeptide contains an IgV domain or specific binding fragments thereof in which the at least one of the amino acid modifications (e.g. substitutions) is in the IgV domain or a specific binding fragment thereof. In some embodiments, by virtue of the altered binding activity or affinity, the altered IgV domain or IgC (e.g. IgC2) domain is an affinity-modified IgSF domain.

In some embodiments, the variant is modified in one more IgSF domains relative to the sequence of an unmodified PD-L2 sequence. In some embodiments, the unmodified PD-L2 sequence is a wild-type PD-L2. In some embodiments, the unmodified or wild-type PD-L2 has the sequence of a native PD-L2 or an ortholog thereof. In some embodiments, the unmodified PD-L2 is or comprises the extracellular domain (ECD) of PD-L2 or a portion thereof containing one or more IgSF domain (see Table 2). In some embodiments, the extracellular domain of an unmodified or wild-type PD-L2 polypeptide comprises an IgV domain and an IgC (e.g. IgC2) domain or domains. However, the variant PD-L2 polypeptide need not comprise both the IgV domain and the IgC (e.g. IgC2) domain or domains. In some embodiments, the variant PD-L2 polypeptide comprises or consists essentially of the IgV domain or a specific binding fragment thereof. In some embodiments, the variant PD-L2 polypeptide comprises or consists essentially of one or both of the IgC (e.g. IgC2) domain or specific binding fragments thereof. In some embodiments, the variant PD-L2 polypeptide comprises or consists essentially of only one of the IgC (e.g. IgC2) domain or a specific binding fragment thereof. In some embodiments, the variant PD-L2 polypeptide comprises the IgV domain or a specific binding fragment thereof, and the first and second IgC (e.g. IgC2) domains or specific binding fragment thereof. In some embodiments, the variant PD-L2 is soluble and lacks a transmembrane domain. In some embodiments, the variant PD-L2 further comprises a transmembrane domain and, in some cases, also a cytoplasmic domain.

In some embodiments, the wild-type or unmodified PD-L2 sequence is a mammalian PD-L2 sequence. In some embodiments, the wild-type or unmodified PD-L2 sequence can be a mammalian PD-L2 that includes, but is not limited to, human, mouse, cynomolgus monkey, or rat. In some embodiments, the wild-type or unmodified PD-L2 sequence is human.

In some embodiments, the wild-type or unmodified PD-L2 sequence has (i) the sequence of amino acids set forth in SEQ ID NO:3 or a mature form thereof lacking the signal sequence, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:3 or the mature form thereof, or (iii) is a portion of (i) or (ii) containing an IgV domain or IgC (e.g. IgC2) domain or specific binding fragments thereof.

In some embodiments, the wild-type or unmodified PD-L2 sequence is or comprises an extracellular domain of the PD-L2 or a portion thereof. In some embodiments, the unmodified or wild-type PD-L2 polypeptide comprises the amino acid sequence set forth in SEQ ID NO: 31, or an ortholog thereof. In some cases, the unmodified or wild-type PD-L2 polypeptide can comprise (i) the sequence of amino acids set forth in SEQ ID NO: 31, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 31, or (iii) is a specific binding fragment of the sequence of (i) or (ii) comprising an IgV domain or an IgC (e.g. IgC2) domain.

In some embodiments, the wild-type or unmodified PD-L2 polypeptide comprises an IgV domain or an IgC (e.g. IgC2) domain or domains, or a specific binding fragment thereof. In some embodiments, the IgV domain of the wild-type or unmodified PD-L2 polypeptide comprises the amino acid sequence set forth in SEQ ID NO: 55 (corresponding to amino acid residues 21-118 of SEQ ID NO: 4), or an ortholog thereof. For example, the IgV domain of the unmodified or wild-type PD-L2 polypeptide can contain (i) the sequence of amino acids set forth in SEQ ID NO: 55, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 55, or (iii) a specific binding fragment of the sequence of (i) or (ii). In some embodiments, the wild-type or unmodified IgV domain is capable of binding one or more PD-L2 cognate binding proteins, such as one or more of PD-1 or RGMb.

In some embodiments, a first IgC2 domain of the wild-type or unmodified PD-L2 polypeptide comprises the amino acid sequence set forth as residues 122-203 of SEQ ID NO: 4, or an ortholog thereof. For example, an IgC2 domain of the unmodified or wild-type PD-L2 polypeptide can contain (i) the sequence of amino acids set forth residues 122-203 of SEQ ID NO: 4, (ii) a sequence of amino acids that has at least about 85%, 86%, 87%, 88%, 89%, 90%, 91%, 92%, 93%, 94%, 95%, 96%, 97%, 98%, 99% sequence identity to residues 122-203 of SEQ ID NO: 4, or (iii) a specific binding fragment of (i) or (ii). In some embodiments, the wild-type or unmodified IgC domain is capable of binding one or more PD-L2 cognate binding proteins.

In some embodiments, the wild-type or unmodified PD-L2 polypeptide contains a specific binding fragment of PD-L2, such as a specific binding fragment of the IgV domain or the IgC (e.g. IgC2) domain. In some embodiments the specific binding fragment can bind PD-1 and/or RGMb. The specific binding fragment can have an amino acid length of at least 50 amino acids, such as at least 60, 70, 80, 90, 100, or 110 amino acids. In some embodiments, a specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 21-118 of SEQ ID NO: 4. In some embodiments, a specific binding fragment of an IgC (e.g. IgC2) domain comprises an amino acid sequence that is at least about 85%, 86%, 87%, 88%, 89%, 90%, 91%, 92%, 93%, 94%, 95%, 96%, 97%, 98%, 99% of the length of the IgC domain set forth as amino acids 122-203 of SEQ ID NO: 3.

In some embodiments, the variant PD-L2 polypeptide comprises the ECD domain or a portion thereof comprising one or more affinity modified IgSF domains. In some embodiments, the variant PD-L2 polypeptides can comprise an IgV domain or an IgC (e.g. IgC2) domain or domains, or a specific binding fragment of the IgV domain or a specific binding fragment of the IgC (e.g. IgC2) domain or domains in which one or more of the IgSF domains (IgV or IgC) contains the one or more amino acid modifications (e.g. substitutions). In some embodiments, the variant PD-L2 polypeptides can comprise an IgV domain and an IgC (e.g. IgC2) domain or domains, or a specific binding fragment of the IgV domain and a specific binding fragment of the IgC (e.g. IgC2) domain or domains, in which at least one of the IgV or IgC domain contains the amino acid modifications (e.g. substitutions). In some embodiments, the variant PD-L2 polypeptide comprises a full-length IgV domain. In some embodiments, the variant PD-L2 polypeptide comprises a full-length IgC (e.g. IgC2) domain or domains. In some embodiments, the variant PD-L2 polypeptide comprises a specific binding fragment of the IgV domain. In some embodiments, the variant PD-L2 polypeptide comprises a specific binding fragment of the IgC (e.g. IgC2) domain or domains. In some embodiments, the variant PD-L2 polypeptide comprises a full-length IgV domain and a full-length IgC (e.g. IgC2) domain or domains. In some embodiments, the variant PD-L2 polypeptide comprises a full-length IgV domain and a specific binding fragment of an IgC (e.g. IgC2) domain or domains. In some embodiments, the variant PD-L2 polypeptide comprises a specific binding fragment of an IgV domain and a full-length IgC (e.g. IgC2) domain or domains. In some embodiments, the variant PD-L2 polypeptide comprises a specific binding fragment of an IgV domain and a specific binding fragment of an IgC (e.g. IgC2) domain or domains.

In any of such embodiments, the one or more amino acid modifications (e.g. substitutions) of the variant PD-L2 polypeptides can be located in any one or more of the PD-L2 polypeptide IgSF domains. For example, in some embodiments, one or more amino acid modifications (e.g. substitutions) are located in the extracellular domain of the variant PD-L2 polypeptide. In some embodiments, one or more amino acid modifications (e.g. substitutions) are located in the IgV domain or specific binding fragment of the IgV domain. In some embodiments, one or more amino acid modifications (e.g. substitutions) are located in an IgC (e.g. IgC2) domain or specific binding fragment of an IgC (e.g. IgC2) domain.

Generally, each of the various attributes of polypeptides are separately disclosed below (e.g., soluble and membrane bound polypeptides, affinity of PD-L2 for PD-1 and RGMb, number of variations per polypeptide chain, number of linked polypeptide chains, the number and nature of amino acid alterations per variant PD-L2, etc.). However, as will be clear to the skilled artisan, any particular polypeptide can comprise a combination of these independent attributes. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three or four) longer or shorter.

Further, various embodiments of the invention as discussed below are frequently provided within the meaning of a defined term as disclosed above. The embodiments described in a particular definition are therefore to be interpreted as being incorporated by reference when the defined term is utilized in discussing the various aspects and attributes described herein. Thus, the headings, the order of presentation of the various aspects and embodiments, and the separate disclosure of each independent attribute is not meant to be a limitation to the scope of the present disclosure.

Exemplary Modifications

Provided herein are variant PD-L2 polypeptides containing at least one affinity-modified IgSF domain (e.g. IgV or IgC) or a specific binding fragment thereof relative to an IgSF domain contained in a wild-type or unmodified PD-L2 polypeptide such that the variant PD-L2 polypeptide exhibits altered (increased or decreased) binding activity or affinity for one or more ligands PD-1 or RGMb compared to a wild-type or unmodified PD-L2 polypeptide. In some embodiments, a variant PD-L2 polypeptide has a binding affinity for PD-1 and/or RGMb that differs from that of a wild-type or unmodified PD-L2 polypeptide control sequence as determined by, for example, solid-phase ELISA immunoassays, flow cytometry, ForteBio Octet or Biacore assays. In some embodiments, the variant PD-L2 polypeptide has an increased binding affinity for PD-1 and/or RGMb. In some embodiments, the variant PD-L2 polypeptide has a decreased binding affinity for PD-1 and/or RGMb, relative to a wild-type or unmodified PD-L2 polypeptide. The PD-1 and/or the RGMb can be a mammalian protein, such as a human protein or a murine protein.

Binding affinities for each of the cognate binding partners are independent; that is, in some embodiments, a variant PD-L2 polypeptide has an increased binding affinity for one or both of PD-1 and/or RGMb, and a decreased binding affinity for one or both of PD-1 and RGMb, relative to a wild-type or unmodified PD-L2 polypeptide.

In some embodiments, the variant PD-L2 polypeptide has an increased binding affinity for PD-1, relative to a wild-type or unmodified PD-L2 polypeptide. In some embodiments, the variant PD-L2 polypeptide has an increased binding affinity for RGMb, relative to a wild-type or unmodified PD-L2 polypeptide. In some embodiments, the variant PD-L2 polypeptide has a decreased binding affinity for PD-1, relative to a wild-type or unmodified PD-L2 polypeptide. In some embodiments, the variant PD-L2 polypeptide has a decreased binding affinity for RGMb, relative to a wild-type or unmodified PD-L2polypeptide.

In some embodiments, the variant PD-L2 polypeptide has an increased binding affinity for PD-1 and RGMb, relative to a wild-type or unmodified PD-L2 polypeptide. In some embodiments, the variant PD-L2 polypeptide has an increased binding affinity for PD-1 and a decreased binding affinity for RGMb, relative to a wild-type or unmodified PD-L2 polypeptide. In some embodiments, the variant PD-L2 polypeptide has a decreased binding affinity for PD-1 and RGMb, relative to a wild-type or unmodified PD-L2 polypeptide. In some embodiments, the variant PD-L2 polypeptide has a decreased binding affinity for PD-1 and an increased binding affinity for RGMb, relative to a wild-type or unmodified PD-L2 polypeptide.

In some embodiments, a variant PD-L2 polypeptide with increased or greater binding affinity to PD-1 and/or RGMb will have an increase in binding affinity relative to the wild-type or unmodified PD-L2 polypeptide control of at least about 5%, such as at least about 10%, 15%, 20%, 25%, 35%, or 50% for the PD-1 and/or RGMb. In some embodiments, the increase in binding affinity relative to the wild-type or unmodified PD-L2 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified PD-L2 polypeptide has the same sequence as the variant PD-L2 polypeptide except that it does not contain the one or more amino acid modifications (e.g. substitutions).

In some embodiments, a variant PD-L2 polypeptide with reduced or decreased binding affinity to PD-1 and/or RGMb will have decrease in binding affinity relative to the wild-type or unmodified PD-L2 polypeptide control of at least 5%, such as at least about 10%, 15%, 20%, 30%, 40%, 50%, 60%, 70%, 80%, 90% or more for the PD-1 and/or RGMb. In some embodiments, the decrease in binding affinity relative to the wild-type or unmodified PD-L2 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified PD-L2 polypeptide has the same sequence as the variant PD-L2 polypeptide except that it does not contain the one or more amino acid modifications (e.g. substitutions).

In some embodiments, the equilibrium dissociation constant ($K_d$) of any of the foregoing embodiments to PD-1 and/or RGMb can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$ M, or $1\times10^{-12}$ M or less.

The wild-type or unmodified PD-L2 sequence does not necessarily have to be used as a starting composition to generate variant PD-L2 polypeptides described herein. Therefore, use of the term "modification", such as "substitution" does not imply that the present embodiments are limited to a particular method of making variant PD-L2 polypeptides. Variant PD-L2 polypeptides can be made, for example, by de novo peptide synthesis and thus does not necessarily require a modification, such as a "substitution" in the sense of altering a codon to encode for the modification, e.g. substitution. This principle also extends to the terms "addition" and "deletion" of an amino acid residue which likewise do not imply a particular method of making.

The means by which the variant PD-L2 polypeptides are designed or created is not limited to any particular method. In some embodiments, however, a wild-type or unmodified PD-L2 encoding nucleic acid is mutagenized from wild-type or unmodified PD-L2 genetic material and screened for desired specific binding affinity and/or induction of IFN-gamma expression or other functional activity. In some embodiments, a variant PD-L2 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database.

Unless stated otherwise, as indicated throughout the present disclosure, the amino acid modification(s) are designated by amino acid position number corresponding to the numbering of positions of the unmodified ECD sequence set forth in SEQ ID NO:31 or also, where applicable, the unmodified IgV sequence set forth in SEQ ID NO:55 or SEQ ID NO:115 (containing residues 1-102 of SEQ ID NO:31) as follows:

(SEQ ID NO: 31)
LFTVTVPKELYIIEHGSNVTLECNFDTGSHVNLGAITASLQKVENDTSPH

RERATLLEEQLPLGKASFHIPQVQVRDEGQYQCIIIYGVAWDYKYLTLKV

KASYRKINTHILKVPETDEVELTCQATGYPLAEVSWPNVSVPANTSHSRT

PEGLYQVTSVLRLKPPPGRNFSCVFWNTHVRELTLASIDLQSQMEPRTHP

T (SEQ ID NO: 55)
FTVTVPKELYIIEHGSNVTLECNFDTGSHVNLGAITASLQKVENDTSPHR

ERATLLEEQLPLGKASFHIPQVQVRDEGQY QCIIIYGVAW DYKYLTLK (SEQ ID NO: 115)
LFTVTVPKELYIIEHGSNVTLECNFDTGSHVNLGAITASLQKVENDTSPH

RERATLLEEQLPLGKASFHIPQVQVRDEGQY QCIIIYGVAW

DYKYLTLKVKA

It is within the level of a skilled artisan to identify the corresponding position of a modification, e.g. amino acid substitution, in a PD-L2 polypeptide, including portion thereof containing an IgSF domain (e.g. IgV) thereof, such as by alignment of a reference sequence with SEQ ID NO:31, SEQ ID NO:55 or SEQ ID NO:115. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the variant PD-L2 polypeptide has one or more amino acid modifications, e.g. substitutions in a wild-type or unmodified PD-L2 sequence. The one or more amino acid modifications, e.g. substitutions can be in the ectodomain (extracellular domain) of the wild-type or unmodified PD-L2 sequence. In some embodiments, the one or more amino acid modifications, e.g. substitutions are in the IgV domain or specific binding fragment thereof. In some embodiments, the one or more amino acid modifications, e.g. substitutions are in an IgC (e.g. IgC2) domain or specific binding fragment thereof. In some embodiments of the variant PD-L2 polypeptide, some of the one or more amino acid modifications, e.g. substitutions are in the IgV domain or a specific binding fragment thereof, and some of the one or more amino acid modifications, e.g. substitutions are in an IgC domain or domains (e.g. IgC2) or a specific binding fragment thereof.

In some embodiments, the variant PD-L2 polypeptide has up to 1, 2, 3, 4, 5, 6, 7, 8, 9, 10, 11, 12, 13, 14, 15, 16, 17, 18, 19, or 20 amino acid modifications, e.g. substitutions. The modifications, e.g. substitutions can be in the IgV domain or the IgC (e.g. IgC2) domain or domains. In some embodiments, the variant PD-L2 polypeptide has up to 1, 2, 3, 4, 5, 6, 7, 8, 9, 10, 11, 12, 13, 14, 15, 16, 17, 18, 19, or 20 amino acid modifications, e.g. substitutions in the IgV domain or specific binding fragment thereof. In some embodiments, the variant PD-L2 polypeptide has up to 1, 2, 3, 4, 5, 6, 7, 8, 9, 10, 11, 12, 13, 14, 15, 16, 17, 18, 19, or 20 amino acid modifications, e.g. substitutions in the IgC (e.g. IgC2) domain or domains or specific binding fragment thereof. In some embodiments, the variant PD-L2 polypeptide has at least about 85%, 86%, 86%, 88%, 89%, 90%, 91%, 92%, 93%, 94%, 95%, 96%, 97%, 98%, or 99% sequence identity with the wild-type or unmodified PD-L2 polypeptide or specific binding fragment thereof, such as with the amino acid sequence of SEQ ID NO: 31, 55 or 115.

In some embodiments, the variant PD-L2 polypeptide has one or more amino acid modifications, e.g. substitutions in an unmodified PD-L2 or specific binding fragment thereof corresponding to position(s) 2, 12, 13, 15, 18, 20, 23, 24, 28, 31, 32, 33, 36, 37, 39, 44, 45, 46, 47, 48, 58, 59, 65, 67, 69, 71, 72, 73, 74, 75, 76, 77, 82, 85, 86, 89, or 91 with reference to positions set forth in SEQ ID NO: 31. In some embodiments, such variant PD-L2 polypeptides exhibit altered binding affinity to one or more of PD-1 and/or RGMb compared to the wild-type or unmodified PD-L2 polypeptide. For example, in some embodiments, the variant PD-L2 polypeptide exhibits increased binding affinity to PD-1 and/or RGMb compared to a wild-type or unmodified PD-L2 polypeptide. In some embodiments, the variant PD-L2 polypeptide exhibits decreased binding affinity to PD-1 or RGMb compared to a wild-type or unmodified PD-L2 polypeptide.

In some embodiments, the variant PD-L2 polypeptide has one or more amino acid modifications, e.g. amino acid substitutions, selected from F2L, I12V, I13V, H15Q, N18D, T20A, N24S, C23S, G28V, N24D, V31A, V31M, N32D, L33P, L33H, L33F, I36V, T37A, S48C, S39I, E44D, E44V, N45S, D46E, T47A, E58G, E59G, K65R, S67L, H69L, P71S, Q72H, V73A, Q74R, V75G, R76G, D77N, Q82R, I85F, I86T, V89D, or W91R, or a conservative amino acid substitution thereof. A conservative amino acid substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine).

In some embodiments, the variant PD-L2 polypeptide has two or more amino acid modifications, e.g. amino acid substitutions, selected from F2L, I12V, I13V, H15Q, N18D, T20A, N24S, C23S, G28V, N24D, V31A, V31M, N32D, L33P, L33H, L33F, I36V, T37A, S48C, S39I, E44D, E44V, N45S, D46E, T47A, E58G, E59G, K65R, S67L, H69L, P71S, Q72H, V73A, Q74R, V75G, R76G, D77N, Q82R, I85F, I86T, V89D, or W91R.

In some embodiments, the amino acid modifications, e.g. amino acid substitutions, of a variant PD-L2 polypeptide include H15Q, N24D, E44D, V89D, Q82R/V89D, E59G/Q82R, S39I/V89D, S67L/V89D, S67L/I85F, S67L/I86T, H15Q/K65R, H15Q/Q72H/V89D, H15Q/S67L/R76G, H15Q/R76G/I85F, H15Q/T47A/Q82R, H15Q/Q82R/V89D, H15Q/C23S/I86T, H15Q/S39I/I86T, E44D/V89D/W91R, I13V/S67L/V89D, H15Q/S67L/I86T, I13V/H15Q/S67L/I86T, I13V/H15Q/E44D/V89D, I13V/S39I/E44D/Q82R/V89D, I13V/E44D/Q82R/V89D, I13V/Q72H/R76G/I86T, I13V/H15Q/R76G/I85F, H15Q/S39I/R76G/V89D, H15Q/S67L/R76G/I85F, H15Q/T47A/Q72H/R76G/I86T, H15Q/T47A/Q72H/R76G, I13V/H15Q/T47A/Q72H/R76G, H15Q/E44D/R76G/I85F, H15Q/S39I/S67L/V89D, H15Q/N32D/S67L/V89D, N32D/S67L/V89D, H15Q/S67L/Q72H/R76G/V89D, H15Q/Q72H/Q74R/R76G/I86T, G28V/Q72H/R76G/I86T, I13V/H15Q/S39I/E44D/S67L, E44D/S67L/Q72H/Q82R/V89D, H15Q/V89D, H15Q/T47A, I13V/H15Q/Q82R, I13V/H15Q/V89D, I13V/S67L/Q82R/V89D, I13V/H15Q/Q82R/V89D, H15Q/V31M/S67L/Q82R/V89D, I13V/H15Q/T47A/Q82R, I13V/H15Q/V31A/N45S/Q82R/V89D, H15Q/T47A/H69L/Q82R/V89D, I13V/H15Q/T47A/H69L/R76G/V89D, I12V/I13V/H15Q/T47A/Q82R/V89D, I13V/H15Q/R76G/D77N/Q82R/V89D, I13V/H15Q/T47A/R76G/V89D, I13V/H15Q/T47A/Q82R/V89D, I13V/H15Q/N24D/Q82R/V89D, I13V/H15Q/I36V/T47A/S67L/V89D, H15Q/T47A/K65R/S67L/Q82R/V89D, H15Q/L33P/T47A/S67L/P71S/V89D, I13V/H15Q/Q72H/R76G/I86T, H15Q/T47A/S67L/Q82R/V89D, F2L/H15Q/D46E/T47A/Q72H/R76G/Q82R/V89D, I13V/H15Q/L33F/T47A/Q82R/V89D, I13V/H15Q/T47A/E58G/S67L/Q82R/V89D, H15Q/N24S/T47A/Q72H/R76G/V89D, I13V/H15Q/E44V/T47A/Q82R/V89D, H15Q/N18D/T47A/Q72H/V73A/R76G/I86T/V89D, I13V/H15Q/T37A/E44D/S48C/S67L/Q82R/V89D, H15Q/L33H/S67L/R76G/Q82R/V89D, I13V/H15Q/T47A/Q72H/R76G/I86T, H15Q/S39I/E44D/Q72H/V75G/R76G/Q82R/V89D, H15Q/T47A/S67L/R76G/Q82R/V89D, or I13V/H15Q/T47A/S67L/Q72H/R76G/Q82R/V89D.

In some embodiments, the variant PD-L2 polypeptide comprises amino acid modifications in an unmodified PD-L2 or specific binding fragment thereof at a position corresponding to position 13, with reference to positions set forth in SEQ ID NO: 31. In some embodiments, the amino acid modification is the amino acid substitution I13V or a conservative amino acid substitution thereof. In some embodiments, the variant PD-L2 polypeptide further contains one or more amino acid modifications, e.g. amino acid substitutions, at one or more positions 15, 44, 47, 67, 72, 72, 76, 82, 86 or 89. In some embodiments, the one or more amino acid modification is one or more amino acid substitutions H15Q, E44D, T47A, S67L, Q72H, R76G, Q82R, I86T, V89D, or a conservative amino acid substitution thereof. In some embodiments, the variant PD-L2 polypeptide comprises the amino acid modifications I13V/H15Q, I13V/E44D, I13V/T47A, I13V/S67L, I13V/Q72H, I13V/R76G, I13V/Q82R, I13V/I86T or I13V/V89D.

In some embodiments, the variant PD-L2 polypeptide comprises amino acid modifications in an unmodified PD-L2 or specific binding fragment thereof at a position corresponding to position 15, with reference to positions set forth in SEQ ID NO: 31. In some embodiments, the amino acid modification is the amino acid substitution H15Q or a conservative amino acid substitution thereof. In some embodiments, the variant PD-L2 polypeptide further contains one or more amino acid modifications, e.g. amino acid substitutions, at one or more positions 13, 44, 47, 67, 72, 72, 76, 82, 86 or 89. In some embodiments, the one or more amino acid modification is one or more amino acid substitutions I13V, E44D, T47A, S67L, Q72H, R76G, Q82R, I86T, V89D, or a conservative amino acid substitution thereof. In some embodiments, the variant PD-L2 polypeptide comprises the amino acid modifications I13V/H15Q, H15Q/E44D, H15Q/T47A, H15Q/S67L, H15Q/Q72H, H15Q/R76G, H15Q/Q82R, H15Q/I86T or H15Q/V89D. In some embodiments, the variant PD-L2 polypeptide comprises the amino acid modifications H15Q/S62L/Q82R, H15Q/S62L/V89D, or H15Q/Q82R/V89D.

In some embodiments, the variant PD-L2 polypeptide comprises amino acid modifications in an unmodified PD-L2 or specific binding fragment thereof at a position corresponding to position 47, with reference to positions set forth in SEQ ID NO: 31. In some embodiments, the amino acid modification is the amino acid substitution T47A or a conservative amino acid substitution thereof. In some embodiments, the variant PD-L2 polypeptide further contains one or more amino acid modifications, e.g. amino acid substitutions, at one or more positions 13, 15, 44, 67, 72, 72, 76, 82, 86 or 89. In some embodiments, the one or more amino acid modification is one or more amino acid substitutions I13V, H15Q, E44D, S67L, Q72H, R76G, Q82R, I86T, V89D, or a conservative amino acid substitution thereof. In some embodiments, the variant PD-L2 polypeptide comprises the amino acid modifications I13V/T47A, H15Q/T47A, T47A/E44D, T47A/S67L, T47A/Q72H, T47A/R76G, T47A/Q82R, T47A/I86T or T47A/V89D.

In some embodiments, the variant PD-L2 polypeptide comprises amino acid modifications in an unmodified PD-L2 or specific binding fragment thereof at a position corresponding to position 67, with reference to positions set forth in SEQ ID NO: 31. In some embodiments, the amino acid modification is the amino acid substitution S67L or a conservative amino acid substitution thereof. In some embodiments, the variant PD-L2 polypeptide further contains one or more amino acid modifications, e.g. amino acid substitutions, at one or more positions 13, 15, 44, 47, 72, 72, 76, 82, 86 or 89. In some embodiments, the one or more amino acid modification is one or more amino acid substitutions I13V, H15Q, E44D, T47A, Q72H, R76G, Q82R, I86T, V89D, or a conservative amino acid substitution thereof. In some embodiments, the variant PD-L2 polypeptide comprises the amino acid modifications I13V/S67L, H15Q/S67L, S67L/E44D, T47A/S67L, S67L/Q72H, S67L/R76G, S67L/Q82R, S67L/I86T or S67L/V89D. In some embodiments, the variant PD-L2 polypeptide comprises the amino acid modifications H15Q/S62L/Q82R, H15Q/S62L/V89D, or S62L/Q82R/V89D.

In some embodiments, the variant PD-L2 polypeptide comprises amino acid modifications in an unmodified PD-L2 or specific binding fragment thereof at a position corresponding to position 72, with reference to positions set forth in SEQ ID NO: 31. In some embodiments, the amino acid modification is the amino acid substitution Q72H or a conservative amino acid substitution thereof. In some embodiments, the variant PD-L2 polypeptide further contains one or more amino acid modifications, e.g. amino acid substitutions, at one or more positions 13, 15, 44, 47, 67, 76, 82, 86 or 89. In some embodiments, the one or more amino acid modification is one or more amino acid substitutions I13V, H15Q, E44D, T47A, S67L, R76G, Q82R, I86T, V89D, or a conservative amino acid substitution thereof. In some embodiments, the variant PD-L2 polypeptide comprises the amino acid modifications I13V/Q72H, H15Q/Q72H, Q72H/E44D, T47A/Q72H, S67L/Q72H, Q72H/R76G, Q72H/Q82R, Q72H/I86T or Q72H/V89D.

In some embodiments, the variant PD-L2 polypeptide comprises amino acid modifications in an unmodified PD-L2 or specific binding fragment thereof at a position corresponding to position 76, with reference to positions set forth in SEQ ID NO: 31. In some embodiments, the amino acid modification is the amino acid substitution R76G or a conservative amino acid substitution thereof. In some embodiments, the variant PD-L2 polypeptide further contains one or more amino acid modifications, e.g. amino acid substitutions, at one or more positions 13, 15, 44, 47, 67, 72, 82, 86 or 89. In some embodiments, the one or more amino acid modification is one or more amino acid substitutions I13V, H15Q, E44D, T47A, S67L, Q72H, Q82R, I86T, V89D, or a conservative amino acid substitution thereof. In some embodiments, the variant PD-L2 polypeptide comprises the amino acid modifications I13V/R76G, H15Q/R76G, E44D/R76G, T47A/R76G, S67L/R76G, Q72H/R76G, R76G/Q82R, R76G/I86T or R76G/V89D.

In some embodiments, the variant PD-L2 polypeptide comprises amino acid modifications in an unmodified PD-L2 or specific binding fragment thereof at a position corresponding to position 82, with reference to positions set forth in SEQ ID NO: 31. In some embodiments, the amino acid modification is the amino acid substitution Q82R or a conservative amino acid substitution thereof. In some embodiments, the variant PD-L2 polypeptide further contains one or more amino acid modifications, e.g. amino acid substitutions, at one or more positions 13, 15, 44, 47, 67, 72, 76, 86 or 89. In some embodiments, the one or more amino acid modification is one or more amino acid substitutions I13V, H15Q, E44D, T47A, S67L, Q72H, R76G, I86T, V89D, or a conservative amino acid substitution thereof. In some embodiments, the variant PD-L2 polypeptide comprises the amino acid modifications I13V/Q82R, H15Q/Q82R, E44D/Q82R, T47A/Q82R, S67L/Q82A, Q72H/Q82R, R76G/Q82R, Q82R/I86T or Q86R/V89D.

In some embodiments, the variant PD-L2 polypeptide comprises amino acid modifications in an unmodified PD-L2 or specific binding fragment thereof at a position corresponding to position 86, with reference to positions set forth in SEQ ID NO: 31. In some embodiments, the amino acid modification is the amino acid substitution I86T or a conservative amino acid substitution thereof. In some embodiments, the variant PD-L2 polypeptide further contains one or more amino acid modifications, e.g. amino acid substitutions, at one or more positions 13, 15, 44, 47, 67, 72, 76, 82 or 89. In some embodiments, the one or more amino acid modification is one or more amino acid substitutions I13V, H15Q, E44D, T47A, S67L, Q72H, R76G, Q82R, V89D, or a conservative amino acid substitution thereof. In some embodiments, the variant PD-L2 polypeptide comprises the amino acid modifications I13V/I86T, H15Q/I86T, E44D/I86T, T47A/I86T, S67L/I86T, Q72H/I86T, R76G/I86T, Q82R/I86T or I86T/V89D.

In some embodiments, the variant PD-L2 polypeptide comprises amino acid modifications in an unmodified PD-L2 or specific binding fragment thereof at a position corresponding to position 89, with reference to positions set forth in SEQ ID NO: 31. In some embodiments, the amino acid modification is the amino acid substitution V89D or a conservative amino acid substitution thereof. In some embodiments, the variant PD-L2 polypeptide further contains one or more amino acid modifications, e.g. amino acid substitutions, at one or more positions 13, 15, 44, 47, 67, 72, 76, 82 or 86. In some embodiments, the one or more amino acid modification is one or more amino acid substitutions I13V, H15Q, E44D, T47A, S67L, Q72H, R76G, Q82R, I86T, or a conservative amino acid substitution thereof. In some embodiments, the variant PD-L2 polypeptide comprises the amino acid modifications I13V/V89D, H15Q/V89D, E44D/V89D, T47A/V89D, S67L/V89D, Q72H/V89D, R76H/V89D, I86T/V89D. In some embodiments, the variant PD-L2 polypeptide comprises the amino acid modifications H15Q/S62L/V89D, H15Q/Q82R/V89D, or S62L/Q82R/V89D.

In some embodiments, the variant PD-L2 polypeptide comprises any of the substitutions (mutations) listed in Table 1. Table 1 also provides exemplary sequences by reference to SEQ ID NO for the extracellular domain (ECD) or IgV domain of wild-type PD-L2 or exemplary variant PD-L2 polypeptides. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of a variant IgSF polypeptide, such as to ensure proper folding of the domain when expressed. Thus, it is understood that the exemplification of the SEQ ID NOS in Table 1 is not to be construed as limiting. For example, the particular domain, such as the IgV domain, of a variant PD-L2 polypeptide can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the variant PD-L2 polypeptide comprises any of the mutations listed in Table 1. Table 1 also provides exemplary sequences by reference to SEQ ID NO for the extracellular domain (ECD) or IgV domain of wild-type PD-L2 or exemplary variant PD-L2 polypeptides. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of a variant IgSF polypeptide, such as to ensure proper folding of the domain when expressed. Thus, it is understood that the exemplification of the SEQ ID NOs in Table 1 is not to be construed as limiting. For example, the particular domain, such as the IgV domain, of a variant PD-L2 polypeptide can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the variant PD-L2 polypeptide comprises any of the mutations listed in Table 1.

In some embodiments, the variant PD-L2 polypeptide comprises or consists of any of the extracellular domain (ECD) sequences listed in Table 1 (i.e., any one of SEQ ID NOS: 56-106, 108-114 and 116-132). In some embodiments, the variant PD-L2 polypeptide comprises or consists of a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 1 (i.e., any one of SEQ ID NOS: 56-106, 108-114 and 116-132) and contains the amino acid modification(s), e.g. substitution(s) not present in the wild-type or unmodified PD-L2. In some embodiments, the variant PD-L2 polypeptide comprises or consists of a specific binding fragment of any of the extracellular domain (ECD) sequences listed in Table 1 (i.e., any one of SEQ ID NOS: 56-106, 108-114 and 116-132) and contains the amino acid modification(s), e.g. substitution(s) not present in the wild-type or unmodified PD-L2.

In some embodiments, the variant PD-L2 polypeptide comprises or consists of any of the IgV sequences listed in Table 1 (i.e., any one of SEQ ID NOS: 133-183, 185-191, 193-209, 268-318, 320-343). In some embodiments, the variant PD-L2 polypeptide comprises or consists of a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 1 (i.e., any one of SEQ ID NOS: 133-183, 185-191, 193-209, 268-318, 320-343) and contains the amino acid substitution(s) not present in the wild-type or unmodified PD-L2. In some embodiments, the variant PD-L2 polypeptide comprises or consists of a specific binding fragment of any of the IgV sequences listed in Table 1 (i.e., any one of SEQ ID NOS: 133-183, 185-191, 193-209, 268-318, 320-343) and contains the amino acid modification(s), e.g. substitution(s) not present in the wild-type or unmodified PD-L2.

TABLE 1

Exemplary variant PD-L2 polypeptides

| Mutation(s) | ECD SEQ ID NO | IgV SEQ ID NO |
|---|---|---|
| Wild-type | 31 | 55, 115 |
| H15Q | 56 | 133, 268 |
| N24D | 57 | 134, 269 |
| E44D | 58 | 135, 270 |
| V89D | 59 | 136, 271 |
| Q82R/V89D | 60 | 137, 272 |
| E59G/Q82R | 61 | 138, 273 |
| S39I/V89D | 62 | 139, 274 |
| S67L/V89D | 63 | 140, 275 |
| S67L/I85F | 64 | 141, 276 |
| S67L/I86T | 65 | 142, 277 |
| H15Q/K65R | 66 | 143, 278 |
| H15Q/Q72H/V89D | 67 | 144, 279 |
| H15Q/S67L/R76G | 68 | 145, 280 |
| H15Q/R76G/I85F | 69, 74 | 146, 281, 151, 186 |
| H15Q/T47A/Q82R | 70 | 147, 282 |
| H15Q/Q82R/V89D | 71 | 148, 283 |
| H15Q/C23S/I86T | 72 | 149, 284 |
| H15Q/S39I/I86T | 73 | 150, 285 |
| E44D/V89D/W91R | 75 | 152, 287 |
| I13V/S67L/V89D | 76 | 153, 288 |
| H15Q/S67L/I86T | 77 | 154, 289 |
| I13V/H15Q/S67L/I86T | 78 | 155, 290 |
| I13V/H15Q/E44D/V89D | 79 | 156, 291 |
| I13V/S39I/E44D/Q82R/V89D | 80 | 157, 292 |
| I13V/E44D/Q82R/V89D | 81 | 158, 293 |
| I13V/Q72H/R76G/I86T | 82 | 159, 294 |
| I13V/H15Q/R76G/I85F | 83 | 160, 295 |
| H15Q/S39I/R76G/V89D | 84 | 161, 296 |
| H15Q/S67L/R76G/I85F | 85 | 162, 297 |
| H15Q/T47A/Q72H/R76G/I86T | 86 | 163, 298 |
| H15Q/T47A/Q72H/R76G | 87 | 164, 299 |
| I13V/H15Q/T47A/Q72H/R76G | 88 | 165, 300 |
| H15Q/E44D/R76G/I85F | 89 | 166, 301 |
| H15Q/S39I/S67L/V89D | 90 | 167, 302 |
| H15Q/N32D/S67L/V89D | 91 | 168, 303 |
| N32D/S67L/V89D | 92 | 169, 304 |
| H15Q/S67L/Q72H/R76G/V89D | 93 | 170, 305 |
| H15Q/Q72H/Q74R/R76G/I86T | 94 | 171, 306 |

TABLE 1-continued

Exemplary variant PD-L2 polypeptides

| Mutation(s) | ECD SEQ ID NO | IgV SEQ ID NO |
|---|---|---|
| G28V/Q72H/R76G/I86T | 95 | 172, 307 |
| I13V/H15Q/S39I/E44D/S67L | 96 | 173, 308 |
| E44D/S67L/Q72H/Q82R/V89D | 97 | 174, 309 |
| H15Q/V89D | 98 | 175, 310 |
| H15Q/T47A | 99 | 176, 311 |
| I13V/H15Q/Q82R | 100 | 177, 312 |
| I13V/H15Q/V89D | 101 | 178, 313 |
| I13V/S67L/Q82R/V89D | 102 | 179, 314 |
| I13V/H15Q/Q82R/V89D | 103 | 180, 315 |
| H15Q/V31M/S67L/Q82R/V89D | 104 | 181, 316 |
| I13V/H15Q/T47A/Q82R | 105 | 182, 317 |
| I13V/H15Q/V31A/N45S/Q82R/V89D | 106 | 183, 318 |
| H15Q/T47A/H69L/Q82R/V89D | 108 | 185, 320 |
| I13V/H15Q/T47A/H69L/R76G/V89D | 109 | 186, 321 |
| I12V/I13V/H15Q/T47A/Q82R/V89D | 110 | 187, 322 |
| I13V/H15Q/R76G/D77N/Q82R/V89D | 111 | 188, 323 |
| I13V/H15Q/T47A/R76G/V89D | 112 | 189, 324 |
| I13V/H15Q/T47A/Q82R/V89D | 113 | 190, 325 |
| I13V/H15Q/N24D/Q82R/V89D | 114 | 191, 326 |
| I13V/H15Q/I36V/T47A/S67L/V89D | 116 | 193, 327 |
| H15Q/T47A/K65R/S67L/Q82R/V89D | 117 | 194, 328 |
| H15Q/L33P/T47A/S67L/P71S/V89D | 118 | 195, 329 |
| I13V/H15Q/Q72H/R76G/I86T | 119 | 196, 330 |
| H15Q/T47A/S67L/Q82R/V89D | 120 | 197, 331 |
| F2L/H15Q/D46E/T47A/Q72H/R76G/Q82R/V89D | 121 | 198, 332 |
| I13V/H15Q/L33F/T47A/Q82R/V89D | 122 | 199, 333 |
| I13V/H15Q/T47A/E58G/S67L/Q82R/V89D | 123 | 200, 334 |
| H15Q/N24S/T47A/Q72H/R76G/V89D | 124 | 201, 335 |
| I13V/H15Q/E44V/T47A/Q82R/V89D | 125 | 202, 336 |
| H15Q/N18D/T47A/Q72H/V73A/R76G/I86T/V89D | 126 | 203, 337 |
| I13V/H15Q/T37A/E44D/S48C/S67L/Q82R/V89D | 127 | 204, 338 |
| H15Q/L33H/S67L/R76G/Q82R/V89D | 128 | 205, 339 |
| I13V/H15Q/T47A/Q72H/R76G/I86T | 129 | 206, 340 |
| H15Q/S39I/E44D/Q72H/V75G/R76G/Q82R/V89D | 130 | 207, 341 |
| H15Q/T47A/S67L/R76G/Q82R/V89D | 131 | 208, 342 |
| I13V/H15Q/T47A/S67L/Q72H/R76G/Q82R/V89D | 132 | 209, 343 |

In some embodiments, the variant PD-L2 polypeptide exhibits increased affinity for the ectodomain of PD-1 compared to the wild-type or unmodified PD-L2 polypeptide, such as comprising the sequence set forth in SEQ ID NO: 31, 55 or 115. In some embodiments, the PD-L2 polypeptide exhibits increased affinity for the ectodomain of RGMb compared to the wild-type or unmodified PD-L2, such as comprising the sequence set forth in SEQ ID NO: 31, 55 or 115. In some embodiments, the PD-L2 polypeptide exhibits increased affinity for the ectodomain of PD-1 and the ectodomain of RGMb compared to the wild-type or unmodified PD-L2, such as comprising the sequence set forth in SEQ ID NO: 31, 55 or 115.

In some embodiments, the variant PD-L2 polypeptide exhibits increased binding affinity for binding one of the ectodomains of PD-1 or RGMb and exhibits decreased binding affinity for binding to the other of the ectodomains of PD-1 or RGMb compared to the wild-type or unmodified PD-L2 polypeptide, such as comprising the sequence set forth in SEQ ID NO: 31, 55 or 115. In some embodiments, the variant PD-L2 polypeptide exhibits increased affinity for the ectodomain of PD-1, and decreased affinity for the ectodomain of RGMb, compared to wild-type or unmodified PD-L2 polypeptide, such as comprising the sequence set forth in SEQ ID NO: 31, 55 or 115. In some embodiments, the variant PD-L2 polypeptide exhibits increased affinity for the ectodomain of RGMb and decreased affinity for the ectodomain of PD-1, compared to wild-type or unmodified PD-L2 polypeptide, such as comprising the sequence set forth in SEQ ID NO: 31, 55 or 115.

In some embodiments, a variant PD-L2 polypeptide exhibits increased selectivity for PD-1 versus RGMb or other cognate binding partner of PD-L2 compared to the ratio of binding of the unmodified PD-L2 polypeptide, e.g. set forth in SEQ ID NO: 31, 55 or 115, for binding RGMb or other cognate binding partner. In some embodiments, the ratio of PD-1 binding to RGMb binding (PD-1: RGMb binding ratio) is greater than 1. In some embodiments, the variant PD-L2 polypeptide exhibits a ratio of binding PD-1 versus RGMb or other cognate binding partner that is greater than or greater than about or 1.1, 1.2, 1.3, 1.4, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, or more.

III. FORMAT OF VARIANT POLYPEPTIDES

The immunomodulatory polypeptide comprising a variant PD-L2 provided herein in which is contained a vIgD can be formatted in a variety of ways, including as a soluble protein, membrane bound protein or secreted protein. In some embodiments, the particular format can be chosen for the desired therapeutic application. In some cases, an immunomodulatory polypeptide comprising a variant PD-L2 polypeptide is provided in a format to antagonize or block activity of its cognate binding partner, e.g. PD-1. In some embodiments, antagonism of PD-1 may be useful to promote immunity in oncology. In some cases, an immunomodulatory polypeptide comprising a variant PD-L2 polypeptide is provided in a format to agonize or stimulate activity of its cognate binding partner, e.g. PD-1. In some embodiments, agonism of PD-1 may be useful for treating inflammation or autoimmunity. A skilled artisan can readily determine the activity of a particular format, such as for antagonizing or agonizing one or more specific cognate binding partner. Exemplary methods for assessing such activities are provided herein, including in the examples.

In some aspects, provided are immunomodulatory proteins comprising a vIgD of PD-L2 in which such proteins are soluble, e.g. fused to an Fc chain. In some aspects, one or more additional IgSF domain, such as one or more additional vIgD, may be linked to a vIgD of PD-L2 as provided herein (hereinafter called a “stack” or “stacked” immunomodulatory protein). In some embodiments, the modular format of the provided immunomodulatory proteins provides flexibility for engineering or generating immunomodulatory proteins for modulating activity of multiple counter structures (multiple cognate binding partners). In some embodiments, such “stack” molecules can be provided in a soluble format or, in some cases, may be provided as membrane bound or secreted proteins. In some embodiments, a variant PD-L2 immunomodulatory protein is provided as a conjugate in which is contained a vIgD of PD-L2 linked, directly or indirectly, to a targeting agent or moiety, e.g. to an antibody or other binding molecules that specifically binds to a ligand, e.g. an antigen, for example, for targeting or localizing the vIgD to a specific environment or cell, such as when administered to a subject. In some embodiments, the targeting agent, e.g. antibody or other binding molecule, binds to a tumor antigen, thereby localizing the variant PD-L2 containing the vIgD to the tumor microenvironment, for example, to modulate activity of tumor infiltrating lymphocytes (TILs) specific to the tumor microenvironment.

In some embodiments, provided immunomodulatory proteins are expressed in cells and provided as part of an engineered cellular therapy (ECT). In some embodiments, the variant PD-L2 polypeptide is expressed in a cell, such as an immune cell (e.g. T cell or antigen presenting cell), in membrane-bound form, thereby providing a transmembrane immunomodulatory protein (hereinafter also called a “TIP”). In some embodiments, depending on the cognate binding partner recognized by the TIP, engineered cells expressing a TIP can agonize a cognate binding partner by providing a costimulatory signal, either positive to negative, to other engineered cells and/or to endogenous T cells. In some aspects, the variant PD-L2 polypeptide is expressed in a cell, such as an immune cell (e.g. T cell or antigen presenting cell), in secretable form to thereby produce a secreted or soluble form of the variant PD-L2 polypeptide (hereinafter also called a “SIP”), such as when the cells are administered to a subject. In some aspects, a SIP can antagonize a cognate binding partner in the environment (e.g. tumor microenvironment) in which it is secreted. In some embodiments, a variant PD-L2 polypeptide is expressed in an infectious agent (e.g. viral or bacterial agent) which, upon administration to a subject, is able to infect a cell in vivo, such as an immune cell (e.g. T cell or antigen presenting cell), for delivery or expression of the variant polypeptide as a TIP or a SIP in the cell.

In some embodiments, a soluble immunomodulatory polypeptide, such as a variant PD-L2 containing a vIgD, can be encapsulated within a liposome which itself can be conjugated to any one of or any combination of the provided conjugates (e.g., a targeting moiety). In some embodiments, the soluble or membrane bound immunomodulatory polypeptides of the invention are deglycosylated. In more specific embodiments, the variant PD-L2 sequence is deglycosylated. In even more specific embodiments, the IgV and/or IgC (e.g. IgC2) domain or domains of the variant PD-L2 is deglycosylated.

Non-limiting examples of provided formats are described in FIGS. 1A-1C and further described below.

A. Soluble Protein

In some embodiments, the immunomodulatory protein containing a variant PD-L2 polypeptide is a soluble protein. Those of skill will appreciate that cell surface proteins typically have an intracellular, transmembrane, and extracellular domain (ECD) and that a soluble form of such proteins can be made using the extracellular domain or an immunologically active subsequence thereof. Thus, in some embodiments, the immunomodulatory protein containing a variant PD-L2 polypeptide lacks a transmembrane domain or a portion of the transmembrane domain. In some embodiments, the immunomodulatory protein containing a variant PD-L2 lacks the intracellular (cytoplasmic) domain or a portion of the intracellular domain. In some embodiments, the immunomodulatory protein containing the variant PD-L2 polypeptide only contains the vIgD portion containing the ECD domain or a portion thereof containing an IgV domain and/or IgC (e.g. IgC2) domain or domains or specific binding fragments thereof containing the amino acid modification(s).

In some embodiments, the immunomodulatory protein is or contains a variant PD-L2 polypeptide that is in monomer form and/or that exhibits monovalent binding to its binding partner. In some aspects, a variant PD-L2 polypeptide as described, such as a variant PD-L2 that is soluble and/or that lacks a transmembrane domain and intracellular signaling domain, is linked, directly or indirectly, to a further moiety. In some embodiments, the further moiety is a protein, peptide, small molecule or nucleic acid. In some embodiments, the monovalent immunomodulatory protein is a fusion protein. In some embodiments, the moiety is a half-life extending molecule. Exemplary of such half-life extending molecules include, but are not limited to, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof.

In some embodiments, the immunomodulatory polypeptide comprising a variant PD-L2 can be linked to a moiety that includes conformationally disordered polypeptide sequences composed of the amino acids Pro, Ala, and Ser (See e.g., WO2008/155134, SEQ ID NO: 2033). In some cases, the amino acid repeat is at least 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid residues, wherein each repeat comprises (an) Ala, Ser, and Pro residue(s). Thus, provided herein is an immunomodulatory protein is a PASylated protein wherein the variant PD-L1 polypeptide is linked, directly or indirectly via a linker, to Pro/Ala/Ser (PAS). In some embodiments, one or more additional linker structures may be used.

In some embodiments, the moiety facilitates detection or purification of the variant PD-L2 polypeptide. In some cases, the immunomodulatory polypeptide comprises a tag or fusion domain, e.g. affinity or purification tag, linked, directly or indirectly, to the N- and/or c-terminus of the PD-L2 polypeptide. Various suitable polypeptide tags and/or fusion domains are known, and include but are not limited to, a poly-histidine (His) tag, a FLAG-tag (SEQ ID NO: 2034), a Myc-tag, and fluorescent protein-tags (e.g., EGFP, set forth in SEQ ID NOs: 2035-2037). In some cases, the immunomodulatory polypeptide comprising a variant PD-L2 comprises at least six histidine residues (set forth in SEQ ID NO: 1253). In some cases, the immunomodulatory polypeptide comprising a variant PD-L2 further comprises various combinations of moieties. For example, the immunomodulatory polypeptide comprising a variant PD-L2 further comprises one or more polyhistidine-tag and FLAG tag.

In some embodiments, the PD-L2 polypeptide is linked to a modified immunoglobulin heavy chain constant region (Fc) that remains in monovalent form such as set forth in SEQ ID NO: 1187.

In some embodiments, the immunomodulatory protein contains a variant PD-L2 polypeptide that is linked, directly or indirectly via a linker to a multimerization domain. In some aspects, the multimerization domain increases half-life of the molecule. Interaction of two or more variant PD-L2 polypeptides can be facilitated by their linkage, either directly or indirectly, to any moiety or other polypeptide that are themselves able to interact to form a stable structure. For example, separate encoded variant PD-L2 polypeptide chains can be joined by multimerization, whereby multimerization of the polypeptides is mediated by a multimerization domain. Typically, the multimerization domain provides for the formation of a stable protein-protein interaction between a first variant PD-L2 polypeptide and a second variant PD-L2 polypeptide.

Homo- or heteromultimeric polypeptides can be generated from co-expression of separate variant PD-L2 polypeptides. The first and second variant PD-L2 polypeptides can be the same or different. In particular embodiments, the first and second variant PD-L2 polypeptide are the same in a homodimer, and each are linked to a multimerization domain that is the same. In other embodiments, heterodimers can be formed by linking first and second variant PD-L2 polypeptides that are different. In such embodiments, in some aspects the first and second variant PD-L2 polypeptide are linked to different multimerization domains capable of promoting heterodimer formation.

In some embodiments, a multimerization domain includes any capable of forming a stable protein-protein interaction. The multimerization domains can interact via an immunoglobulin sequence (e.g. Fc domain; see e.g., International Patent Pub. Nos. WO 93/10151 and WO 2005/063816 US; U.S. Pub. No. 2006/0024298; U.S. Pat. No. 5,457,035); leucine zipper (e.g. from nuclear transforming proteins fos and jun or the proto-oncogene c-myc or from General Control of Nitrogen (GCN4)) (e.g., Busch and Sassone-Corsi (1990) Trends Genetics, 6:36-40; Gentz et al., (1989) Science, 243:1695-1699); a hydrophobic region; a hydrophilic region; or a free thiol which forms an intermolecular disulfide bond between the chimeric molecules of a homo- or heteromultimer. In addition, a multimerization domain can include an amino acid sequence comprising a protuberance complementary to an amino acid sequence comprising a hole, such as is described, for example, in U.S. Pat. No. 5,731,168; International Patent Pub. Nos. WO 98/50431 and WO 2005/063816; Ridgway et al. (1996) Protein Engineering, 9:617-621. Such a multimerization region can be engineered such that steric interactions not only promote stable interaction, but further promote the formation of heterodimers over homodimers from a mixture of chimeric monomers. Generally, protuberances are constructed by replacing small amino acid side chains from the interface of the first polypeptide with larger side chains (e.g., tyrosine or tryptophan). Compensatory cavities of identical or similar size to the protuberances are optionally created on the interface of the second polypeptide by replacing large amino acid side chains with smaller ones (e.g., alanine or threonine). Exemplary multimerization domains are described below.

The variant PD-L2 polypeptide can be joined anywhere, but typically via its N- or C-terminus, to the N- or C-terminus of a multimerization domain to form a chimeric polypeptide. The linkage can be direct or indirect via a linker. The chimeric polypeptide can be a fusion protein or can be formed by chemical linkage, such as through covalent or non-covalent interactions. For example, when preparing a chimeric polypeptide containing a multimerization domain, nucleic acid encoding all or part of a variant PD-L2 polypeptide can be operably linked to nucleic acid encoding the multimerization domain sequence, directly or indirectly or optionally via a linker domain. In some cases, the construct encodes a chimeric protein where the C-terminus of the variant PD-L2 polypeptide is joined to the N-terminus of the multimerization domain. In some instances, a construct can encode a chimeric protein where the N-terminus of the variant PD-L2 polypeptide is joined to the N- or C-terminus of the multimerization domain.

A polypeptide multimer contains multiple, such as two, chimeric proteins created by linking, directly or indirectly, two of the same or different variant PD-L2 polypeptides directly or indirectly to a multimerization domain. In some examples, where the multimerization domain is a polypeptide, a gene fusion encoding the variant PD-L2 polypeptide and multimerization domain is inserted into an appropriate expression vector. The resulting chimeric or fusion protein can be expressed in host cells transformed with the recombinant expression vector, and allowed to assemble into multimers, where the multimerization domains interact to form multivalent polypeptides. Chemical linkage of multimerization domains to variant PD-L2 polypeptides can be effected using heterobifunctional linkers.

The resulting chimeric polypeptides, such as fusion proteins, and multimers formed therefrom, can be purified by any suitable method such as, for example, by affinity chromatography over Protein A or Protein G columns. Where two nucleic acid molecules encoding different polypeptides are transformed into cells, formation of homo- and heterodimers will occur. Conditions for expression can be adjusted so that heterodimer formation is favored over homodimer formation.

In some embodiments, the multimerization domain is an Fc domain or portions thereof from an immunoglobulin. In some embodiments, the immunomodulatory protein comprises a variant PD-L2 polypeptide attached to an immunoglobulin Fc (yielding an "immunomodulatory Fc fusion," such as a "PD-L2-Fc variant fusion," also termed a PD-L2 vIgD-Fc fusion). In some embodiments, the attachment of the variant PD-L2 polypeptide is at the N-terminus of the Fc. In some embodiments, the attachment of the variant PD-L2 polypeptide is at the C-terminus of the Fc. In some embodiments, two or more PD-L2 variant polypeptides (the same or different) are independently attached at the N-terminus and at the C-terminus.

In some embodiments, the Fc is murine or human Fc. In some embodiments, the Fc is a mammalian or human IgG1, lgG2, lgG3, or lgG4 Fc regions. In some embodiments, the Fc is derived from IgG1, such as human IgG1. In some embodiments, the Fc comprises the amino acid sequence set forth in SEQ ID NO: 211 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 211.

In some embodiments, the Fc region contains one more modifications to alter (e.g. reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. In some cases, effector functions of an Fc region can include programmed cell death and cellular phagocytosis. Additionally, the FcRn sequence present in the Fc region plays the role of regulating the IgG level in serum by increasing the in vivo half-life by conjugation to an in vivo FcRn receptor. In some embodiments, such functions can be reduced or altered in an Fc for use with the provided Fc fusion proteins.

In some embodiments, one or more amino acid modifications may be introduced into the Fc region of a PD-L2-Fc variant fusion provided herein, thereby generating an Fc region variant. In some embodiments, the Fc region variant has decreased effector function. There are many examples of changes or mutations to Fc sequences that can alter effector function. For example, WO 00/42072, WO2006019447, WO2012125850, WO2015/107026, US2016/0017041 and Shields et al. *J Biol. Chem.* 9(2): 6591-6604 (2001) describe exemplary Fc variants with improved or diminished binding to FcRs. The contents of those publications are specifically incorporated herein by reference.

In some embodiments, the provided variant PD-L2-Fc fusions comprise an Fc region that exhibits reduced effector functions, which makes it a desirable candidate for applications in which the half-life of the PD-L2-Fc variant fusion in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the PD-L2-Fc variant fusion lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J Exp. Med.* 166:1351-1361 (1987)). Alternatively, non-radioactive assay methods may be employed (see, for example, ACTI™ non-radioactive cytotoxicity assay for flow cytometry (CellTechnology, Inc. Mountain View, Calif.; and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the PD-L2-Fc variant fusion is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103:2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

PD-L2-Fc variant fusions with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of PD-L2-Fc variant fusions has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268Q/V309L/A330S/A331S, IgG4-L235A/G237A/E318A, and IgG4-L236E described in Current Opinion in Biotechnology (2009) 20 (6), 685-691; alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006019447 and Shields et al., *J. Biol. Chem.* 9(2): 6591-6604 (2001).)

In some embodiments, there is provided a PD-L2-Fc variant fusion comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of a PD-L2-Fc variant fusion comprises one or more amino acid substitution E356D and M358L by EU numbering. In some embodiments, the Fc region of a PD-L2-Fc variant fusion comprises one or more amino acid substitutions C220S, C226S and/or C229S by EU numbering. In some embodiments, the Fc region of a PD-L2 variant fusion comprises one or more amino acid substitutions R292C and V302C. See also Duncan & Winter, Nature 322:738-40 (1988); U.S. Pat. Nos. 5,648,260; 5,624,821; and WO 94/29351 concerning other examples of Fc region variants.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., *J. Immunol.* 164: 4178-4184 (2000).

In some embodiments, there is provided a PD-L2-Fc variant fusion comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 211. In some embodiments, the Fc contains at least one amino acid substitution that is N82G by numbering of SEQ ID NO: 211 (corresponding to N297G by EU numbering). In some embodiments, the Fc further contains at least one amino acid substitution that is R77C or V87C by numbering of SEQ ID NO: 211 (corresponding to R292C or V302C by EU numbering). In some embodiments, the variant Fc region further comprises a C5S amino acid modification by numbering of SEQ ID NO: 211 (corresponding to C220S by EU numbering). For example, in some embodiments, the variant Fc region comprises the following amino acid modifications: V297G and one or more of the following amino acid modifications C220S, R292C or V302C by EU numbering (corresponding to N82G and one or more of the following amino acid modifications C5S, R77C or V87C with reference to SEQ ID NO:211), e.g. the Fc region comprises the sequence set forth in SEQ ID NO:1205. In some embodiments, the variant Fc region comprises one or more of the amino acid modifications C220S, L234A, L235E or G237A, e.g. the Fc region comprises the sequence set forth in SEQ ID NO:1206. In some embodiments, the variant Fc region comprises one or more of the amino acid modifications C220S, L235P, L234V, L235A, G236del or S267K, e.g. the Fc region comprises the sequence set forth in SEQ ID NO:1207. In some embodiments, the variant Fc comprises one or more of the amino acid modifications C220S, L234A, L235E, G237A, E356D or M358L, e.g. the Fc region comprises the sequence set forth in SEQ ID NO:1189.

In some embodiments, the Fc region lacks the C-terminal lysine corresponding to position 232 of the wild-type or unmodified Fc set forth in SEQ ID NO: 211 (corresponding to K447del by EU numbering). In some aspects, such an Fc region can additionally include one or more additional modifications, e.g. amino acid substitutions, such as any as described. Exemplary of such an Fc region is set forth in SEQ ID NO: 1737, 1738, 1739 or 1740.

In some embodiments, there is provided a PD-L2-Fc variant fusion comprising a variant Fc region in which the variant Fc comprises the sequence of amino acids set forth in any of SEQ ID NOS:1189, 1205, 1206, 1207, 1737, 1738, 1739 or 1740 or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 1189, 1205, 1206, 1207, 1737, 1738, 1739 or 1740.

In some embodiments, the Fc is derived from IgG2, such as human IgG2. In some embodiments, the Fc comprises the amino acid sequence set forth in SEQ ID NO: 212 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 212.

In some embodiments, the IgG4 Fc is a stabilized Fc in which the CH3 domain of human IgG4 is substituted with the CH3 domain of human IgG1 and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see e.g. U.S. Pat. No. 8,911,726. In some embodiments, the Fc is an IgG4 containing the S228P mutation, which has been shown to prevent recombination between a therapeutic antibody and an endogenous IgG4 by Fab-arm exchange (see e.g. Labrijin et al. (2009) Nat. Biotechnol., 27(8)767-71.) In some embodiments, the Fc comprises the amino acid sequence of hIgG4.

In some embodiments, the variant PD-L2 polypeptide is directly linked to the Fc sequence. In some embodiments, the variant PD-L2 polypeptide is indirectly linked to the Fc sequence, such as via a linker. In some embodiments, one or more "peptide linkers" link the variant PD-L2 polypeptide and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is three alanines (AAA). In some embodiments, the linker is a flexible linker. In some embodiments, the linker is (in one-letter amino acid code): GGGGS ("4GS" or "G$_4$S"; SEQ ID NO:1742) or multimers of the 4GS linker, such as repeats of 2, 3, 4, or 5 4GS linkers, such as set forth in SEQ ID NO: 264 (2×GGGGS) or SEQ ID NO: 263 (3×GGGGS). In some embodiments, the linker (in one-letter amino acid code) is GSGGGGS (SEQ ID NO:1741). In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 2030 (1×EAAAK), SEQ ID NO: 2031 (3×EAAAK) or SEQ ID NO: 2032 (5×EAAAK). In some embodiments, the linker can further include amino acids introduced by cloning and/or from a restriction site, for example the linker can include the amino acids GS (in one-letter amino acid code) as introduced by use of the restriction site BAMHI. For example, in some embodiments, the linker (in one-letter amino acid code) is GSGGGGS (SEQ ID NO:1741), GS(G$_4$S)$_3$ (SEQ ID NO: 2040), or GS(G$_4$S)$_5$ (SEQ ID NO: 2041). In some examples, the linker is a 2×GGGGS followed by three alanines (GGGGSGGGGSAAA; SEQ ID NO: 265). In some cases, the immunomodulatory polypeptide comprising a variant PD-L2 comprises various combinations of peptide linkers.

In some embodiments, the variant PD-L2-Fc fusion protein is a dimer formed by two variant PD-L2 Fc polypeptides linked to an Fc domain. In some embodiments, the dimer is a homodimer in which the two variant PD-L2 Fc polypeptides are the same. In some embodiments, the dimer is a heterodimer in which the two variant PD-L2 Fc polypeptides are different.

Also provided are nucleic acid molecules encoding the variant PD-L2-Fc fusion protein. In some embodiments, for production of an Fc fusion protein, a nucleic acid molecule encoding a variant PD-L2-Fc fusion protein is inserted into an appropriate expression vector. The resulting variant PD-L2-Fc fusion protein can be expressed in host cells transformed with the expression where assembly between Fc domains occurs by interchain disulfide bonds formed between the Fc moieties to yield dimeric, such as divalent, variant PD-L2-Fc fusion proteins.

The resulting Fc fusion proteins can be easily purified by affinity chromatography over Protein A or Protein G columns. For the generation of heterodimers, additional steps for purification can be necessary. For example, where two nucleic acids encoding different variant PD-L2 polypeptides are transformed into cells, the formation of heterodimers must be biochemically achieved since variant PD-L2 molecules carrying the Fc-domain will be expressed as disulfide-linked homodimers as well. Thus, homodimers can be reduced under conditions that favor the disruption of interchain disulfides, but do no effect intra-chain disulfides. In some cases, different variant-PD-L2 Fc monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing Fc fusion molecules that contain a variant PD-L2 polypeptide using knob-into-hole methods described below.

B. Stack Molecules with Additional IgSF Domains

In some embodiments, the immunomodulatory proteins can contain any of the variant PD-L2 polypeptides provided herein linked, directly or indirectly, to one or more other immunoglobulin superfamily (IgSF) domain ("stacked" immunomodulatory protein construct and also called a "Type II" immunomodulatory protein). In some aspects, this can create unique multi-domain immunomodulatory proteins that bind two or more, such as three or more, cognate binding partners, thereby providing a multi-targeting modulation of the immune synapse.

In some embodiments, an immunomodulatory protein comprises a combination (a "non-wild-type combination") and/or arrangement (a "non-wild type arrangement" or "non-wild-type permutation") of a variant PD-L2 domain with one or more other affinity modified and/or non-affinity modified IgSF domain sequences of another IgSF family member (e.g. a mammalian IgSF family member) that are not found in wild-type IgSF family members. In some embodiments, the immunomodulatory protein contains 2, 3, 4, 5 or 6 immunoglobulin superfamily (IgSF) domains, where at least one of the IgSF domain is a variant PD-L2 IgSF domain (vIgD of PD-L2) according to the provided description.

In some embodiments, the sequences of the additional IgSF domains can be a modified IgSF domain that contains one or more amino acid modifications, e.g. substitutions, compared to a wildtype or unmodified IgSF domain. In some embodiments, the IgSF domain can be non-affinity modified (e.g., wild-type) or have been affinity modified. In some embodiments, the unmodified or wild-type IgSF domain can be from mouse, rat, cynomolgus monkey, or human origin, or combinations thereof. In some embodiments, the additional IgSF domains can be an IgSF domain of an IgSF family member set forth in Table 2. In some embodiments, the additional IgSF domain can be an affinity-modified IgSF domain containing one or more amino acid modifications, e.g. substitutions, compared to an IgSF domain contained in an IgSF family member set forth in Table 2.

In some embodiments, the additional IgSF domain is an affinity or non-affinity modified IgSF domain contained in an IgSF family member of a family selected from Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the additional IgSF domains are independently derived from an IgSF protein selected from the group consisting of CD80(B7-1), CD86 (B7-2), CD274 (PD-L2, B7-H1), PDCD1LG2(PD-L2, CD273), ICOSLG(B7RP1, CD275, ICOSL, B7-H2), CD276(B7-H3), VTCN1(B7-H4), CD28, CTLA4, PDCD1 (PD-1), ICOS, BTLA(CD272), CD4, CD8A(CD8-alpha), CD8B(CD8-beta), LAG3, HAVCR2(TIM-3), CEACAM1, TIGIT, PVR(CD155), PVRL2(CD112), CD226, CD2, CD160, CD200, CD200R1(CD200R), and NC R3 (NKp30).

The first column of Table 2 provides the name and, optionally, the name of some possible synonyms for that particular IgSF member. The second column provides the protein identifier of the UniProtKB database, a publicly available database accessible via the internet at uniprot.org or, in some cases, the GenBank Number. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR)

and supported mainly by a grant from the U.S. National Institutes of Health (NIH). GenBank is the NIH genetic sequence database, an annotated collection of all publicly available DNA sequences (Nucleic Acids Research, 2013 January; 41(D1): D36-42). The third column provides the region where the indicated IgSF domain is located. The region is specified as a range where the domain is inclusive of the residues defining the range. Column 3 also indicates the IgSF domain class for the specified IgSF region. Column 4 provides the region where the indicated additional domains are located (signal peptide, S; extracellular domain, E; transmembrane domain, T; cytoplasmic domain, C). It is understood that description of domains can vary depending on the methods used to identify or classify the domain, and may be identified differently from different sources. The description of residues corresponding to a domain in Table 2 is for exemplification only and can be several amino acids (such as one, two, three or four) longer or shorter. Column 5 indicates for some of the listed IgSF members, some of its cognate cell surface binding partners.

TABLE 2

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| CD80 (B7-1) | NP_005182.1 P33681 | 35-135, 35-138, 37-138 or 35-141 IgV, 145-230 or 154-232 IgC | S: 1-34, E: 35-242, T: 243-263, C: 264-288 | CD28, CTLA4, PD-L1 | SEQ ID NO: 1 (35-288) | SEQ ID NO: 213 | SEQ ID NO: 28 |
| CD86 (B7-2) | P42081.2 | 33-131 IgV, 150-225 IgC2 | S: 1-23, E: 24-247, T: 248-268, C: 269-329 | CD28, CTLA4 | SEQ ID NO: 2 (24-329) | SEQ ID NO: 214 | SEQ ID NO: 29 |
| CD274 (PD-L1, B7-H1) | Q9NZQ7.1 | 24-130 IgV, 133-225 IgC2 | S: 1-18, E: 19-238, T: 239-259, C: 260-290 | PD-1, B7-1 | SEQ ID NO: 3 (19-290) | SEQ ID NO: 215 | SEQ ID NO: 30 |
| PDCD1LG2 (PD-L2, CD273) | Q9BQ51.2 | 21-118 IgV, 122-203 IgC2 | S: 1-19, E: 20-220, T: 221-241, C: 242-273 | PD-1, RGMb | SEQ ID NO: 4 (20-273) | SEQ ID NO: 216 | SEQ ID NO: 31 |
| ICOSLG (B7RP1, CD275, ICOSL, B7-H2) | O75144.2 | 19-129 IgV, 141-227 IgC2 | S: 1-18, E: 19-256, T: 257-277, C: 278-302 | ICOS, CD28, CTLA4 | SEQ ID NO: 5 (19-302) | SEQ ID NO: 217 | SEQ ID NO: 32 |
| CD276 (B7-H3) | Q5ZPR3.1 | 29-139 IgV, 145-238 IgC2, 243-357 IgV2, 363-456, 367-453 IgC2 | S: 1-28, E: 29-466, T: 467-487, C: 488-534 | | SEQ ID NO: 6 (29-534) | SEQ ID NO: 218 | SEQ ID NO: 33 |
| VTCN1 (B7-H4) | Q7Z7D3.1 | 35-146 IgV, 153-241 IgV | S: 1-24, E: 25-259, T: 260-280, C: 281-282 | | SEQ ID NO: 7 (25-282) | SEQ ID NO: 219 | SEQ ID NO: 34 |
| CD28 | P10747.1 | 28-137 IgV | S: 1-18, E: 19-152, T: 153-179, C: 180-220 | B7-1, B7-2, B7RP1 | SEQ ID NO: 8 (19-220) | SEQ ID NO: 220 | SEQ ID NO: 35 |
| CTLA4 | P16410.3 | 39-140 IgV | S: 1-35, E: 36-161, T: 162-182, C: 183-223 | B7-1, B7-2, B7RP1 | SEQ ID NO: 9 (36-223) | SEQ ID NO: 221 | SEQ ID NO: 36 |
| PDCD1 (PD-1) | Q15116.3 | 35-145 IgV | S: 1-20, E: 21-170, T: 171-191, C: 192-288 | PD-L2, PD-L2 | SEQ ID NO: 10 (21-288) | SEQ ID NO: 222 | SEQ ID NO: 37 |
| ICOS | Q9Y6W8.1 | 30-132 IgV | S: 1-20, E: 21-140, T: 141-161, C: 162-199 | B7RP1 | SEQ ID NO: 11 (21-199) | SEQ ID NO: 223 | SEQ ID NO: 38 |
| BTLA (CD272) | Q7Z6A9.3 | 31-132 IgV | S: 1-30, E: 31-157, T: 158-178, C: 179-289 | HVEM | SEQ ID NO: 12 (31-289) | SEQ ID NO: 224 | SEQ ID NO: 39 |
| CD4 | P01730.1 | 26-125 IgV, 126-203 IgC2, 204-317 IgC2, 317-389, 318-374 IgC2 | S: 1-25, E: 26-396, T: 397-418, C: 419-458 | MHC class II | SEQ ID NO: 13 (26-458) | SEQ ID NO: 225 | SEQ ID NO: 40 |

TABLE 2-continued

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| CD8A (CD8-alpha) | P01732.1 | 22-135 IgV | S: 1-21, E: 22-182, T: 183-203, C: 204-235 | MHC class I | SEQ ID NO: 14 (22-235) | SEQ ID NO: 226 | SEQ ID NO: 41 |
| CD8B (CD8-beta) | P10966.1 | 22-132 IgV | S: 1-21, E: 22-170, T: 171-191, C: 192-210 | MHC class I | SEQ ID NO: 15 (22-210) | SEQ ID NO: 227 | SEQ ID NO: 42 |
| LAG3 | P18627.5 | 37-167 IgV, 168-252 IgC2, 265-343 IgC2, 349-419 IgC2 | S: 1-28, E: 29-450, T: 451-471, C: 472-525 | MHC class II | SEQ ID NO: 16 (29-525) | SEQ ID NO: 228 | SEQ ID NO: 43 |
| HAVCR2 (TIM-3) | Q8TDQ0.3 | 22-124 IgV | S: 1-21, E: 22-202, T: 203-223, C: 224-301 | CEACAM-1, phosphatidylserine, Galectin-9, HMGB1 | SEQ ID NO: 17 (22-301) | SEQ ID NO: 229 | SEQ ID NO: 44 |
| CEACAM1 | P13688.2 | 35-142 IgV, 145-232 IgC2, 237-317 IgC2, 323-413 IgC2 | S: 1-34, E: 35-428, T: 429-452, C: 453-526 | TIM-3 | SEQ ID NO: 18 (35-526) | SEQ ID NO: 230 | SEQ ID NO: 45 |
| TIGIT | Q495A1.1 | 22-124 IgV | S: 1-21, E: 22-141, T: 142-162, C: 163-244 | CD155, CD112 | SEQ ID NO: 19 (22-244) | SEQ ID NO: 231 | SEQ ID NO: 46 |
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | SEQ ID NO: 20 (21-417) | SEQ ID NO: 232 | SEQ ID NO: 47 |
| PVRL2 (CD112) | Q92692.1 | 32-156 IgV, 162-256 IgC2, 261-345 IgC2 | S: 1-31, E: 32-360, T: 361-381, C: 382-538 | TIGIT, CD226, CD112R | SEQ ID NO: 21 (32-538) | SEQ ID NO: 233 | SEQ ID NO: 48 |
| CD226 | Q15762.2 | 19-126 IgC2, 135-239 IgC2 | S: 1-18, E: 19-254, T: 255-275, C: 276-336 | CD155, CD112 | SEQ ID NO: 22 (19-336) | SEQ ID NO: 234 | SEQ ID NO: 49 |
| CD2 | P06729.2 | 25-128 IgV, 129-209 IgC2 | S: 1-24, E: 25-209, T: 210-235, C: 236-351 | CD58 | SEQ ID NO: 23 (25-351) | SEQ ID NO: 235 | SEQ ID NO: 50 |
| CD160 | O95971.1 | 27-122 IgV | N/A | HVEM, MHC family of proteins | SEQ ID NO: 24 (27-159) | SEQ ID NO: 236 | SEQ ID NO: 51 |
| CD200 | P41217.4 | 31-141 IgV, 142-232 IgC2 | S: 1-30, E: 31-232, T: 233-259, C: 260-278 | CD200R | SEQ ID NO: 25 (31-278) | SEQ ID NO: 237 | SEQ ID NO: 52 |
| CD200R1 (CD200R) | Q8TD46.2 | 53-139 IgV, 140-228 IgC2 | S: 1-28, E: 29-243, T: 244-264, C: 265-325 | CD200 | SEQ ID NO: 26 (29-325) | SEQ ID NO: 238 | SEQ ID NO: 53 |
| NCR3 (NKp30) | O14931.1 | 19-126 IgC-like | S: 1-18, E: 19-135, T: 136-156, C: 157-201 | B7-H6 | SEQ ID NO: 27 (19-201) | SEQ ID NO: 239 | SEQ ID NO: 54 |
| VSIG8 | Q5VU13 | 22-141 IgV,1 146-257 IgV2 | S: 1-21 E: 22-263 T: 264-284 C: 285-414 | VISTA | SEQ ID NO: 240 (22-414) | SEQ ID NO: 241 | SEQ ID NO: 242 |

In some embodiments, the provided immunomodulatory proteins, in addition to containing a variant PD-L2 polypeptide, also contains at least 2, 3, 4, 5 or 6 additional immunoglobulin superfamily (IgSF) domains, such as an IgD domain of an IgSF family member set forth in Table 2. In some embodiments, the provided immunomodulatory protein contains at least one additional IgSF domain (e.g. second IgSF domain). In some embodiments, the provided immunomodulatory protein contains at least two additional IgSF domains (e.g. second and third IgSF domain). In some embodiments, the provided immunomodulatory protein contains at least three additional IgSF domains (e.g. second, third and fourth). In some embodiments, the provided immunomodulatory protein contains at least four additional IgSF domains (e.g. second, third, fourth and fifth). In some embodiments, the provided immunomodulatory protein contains at least five additional IgSF domains (e.g. second, third, fourth, fifth and sixth). In some embodiments, the provided immunomodulatory protein contains at least six additional IgSF domains (e.g. second, third, fourth, fifth, sixth and seventh). In some embodiments, each of the IgSF domains in the immunomodulatory protein are different. In some embodiments, at least one of the additional IgSF domain is the same as at least one other IgSF domain in the immunomodulatory protein. In some embodiments, each of the IgSF domains is from or derived from a different IgSF family member. In some embodiments, at least two of the IgSF domains is from or derived from the same IgSF family member.

In some embodiments, the additional IgSF domain comprises an IgV domain or an IgC (e.g., IgC2) domain or domains, or a specific binding fragment of the IgV domain or a specific binding fragment of the IgC (e.g., IgC2) domain or domains. In some embodiments, the additional IgSF domain is or comprises a full-length IgV domain. In some embodiments, the additional IgSF domain is or comprises a full-length IgC (e.g., IgC2) domain or domains. In some embodiments, the additional IgSF domain is or comprises a specific binding fragment of the IgV domain. In some embodiments, the additional IgSF domain is or comprises a specific binding fragment of the IgC (e.g., IgC2) domain or domains. In some embodiments, the immunomodulatory protein contains at least two additional IgSF domains from a single (same) IgSF member. For example, in some aspects, the immunomodulatory protein contains an ECD or portion thereof of an IgSF member containing a full-length IgV domain and a full-length IgC (e.g., IgC2) domain or domains or specific binding fragments thereof. In some embodiments, the provided immunomodulatory proteins contains at least one additional IgSF domain (e.g. a second or, in some cases, also a third IgSF domain) in which at least one additional or second IgSF domain is an IgSF domain set forth in a wild-type or unmodified IgSF domain or a specific binding fragment thereof contained in the sequence of amino acids set forth in any of SEQ ID NOS: 1-27 and 240. In some embodiments, the wild-type or unmodified IgSF domain is an IgV domain or an IgC domain, such as an IgC1 or IgC2 domain.

In some embodiments, the provided immunomodulatory proteins, in addition to containing a variant PD-L2 polypeptide, also contains at least one additional affinity-modified IgSF domain (e.g. a second or, in some cases, also a third affinity-modified IgSF domain and so on) in which at least one additional IgSF domain is a vIgD that contains one or more amino acid modifications (e.g. substitution, deletion or mutation) compared to an IgSF domain in a wild-type or unmodified IgSF domain, such as an IgSF domain in an IgSF family member set forth in Table 2. In some embodiments, the additional or second affinity-modified IgSF domain comprises at least 85%, 86%, 87%, 88%, 89%, 90%, 91%, 92%, 93%, 94%, 95%, 96%, 97%, 98%, 99% or more sequence identity to a wild-type or unmodified IgSF domain or a specific binding fragment thereof contained in the sequence of amino acids set forth in any of SEQ ID NOS: 1-27 and 240. In some embodiments, the wild-type or unmodified IgSF domain is an IgV domain or an IgC domain, such as an IgC1 or IgC2 domain. In some embodiments, the additional, e.g., or second or third IgSF domain is an affinity-modified IgV domain and/or IgC domain. In some embodiments, the one or more additional IgSF domain is an affinity-modified IgSF domain that contains an IgV domain and/or an IgC (e.g., IgC2) domain or domains, or a specific binding fragment of the IgV domain and/or a specific binding fragment of the IgC (e.g., IgC2) domain or domains, in which the IgV and/or IgC domain contains the amino acid modification(s) (e.g., substitution(s)). In some embodiments, the one or more additional affinity-modified IgSF domain contains an IgV domain containing the amino acid modification(s) (e.g. substitution(s)). In some embodiments, the one or more additional affinity-modified IgSF domain include IgSF domains present in the ECD or a portion of the ECD of the corresponding unmodified IgSF family member, such as a full-length IgV domain and a full-length IgC (e.g., IgC2) domain or domains, or specific binding fragments thereof, in which one or both of the IgV and IgC contain the amino acid modification(s) (e.g. substitution(s)).

In some embodiments, the immunomodulatory polypeptide comprising a variant PD-L2 can include one or more vIgD of PD-L2 provided herein. In some embodiments, a variant PD-L2 immunomodulatory protein provided herein will comprise exactly 1, 2, 3, 4, 5 or more variant PD-L2 sequences. In some embodiments, at least two of variant PD-L2 sequences are identical variant IgSF domains.

In some embodiments, the provided immunomodulatory polypeptide comprises two or more vIgD sequences of PD-L2. Multiple variant PD-L2 within the polypeptide chain can be identical (i.e., the same species) to each other or be non-identical (i.e., different species) variant PD-L2 sequences. In addition to single polypeptide chain embodiments, in some embodiments two, three, four, or more of the polypeptides of the invention can be covalently or non-covalently attached to each other. Thus, monomeric, dimeric, and higher order (e.g., 3, 4, 5, or more) multimeric proteins are provided herein. For example, in some embodiments exactly two polypeptides of the invention can be covalently or non-covalently attached to each other to form a dimer. In some embodiments, attachment is made via interchain cysteine disulfide bonds. Compositions comprising two or more polypeptides of the invention can be of an identical species or substantially identical species of polypeptide (e.g, a homodimer) or of non-identical species of polypeptides (e.g., a heterodimer). A composition having a plurality of linked polypeptides of the invention can, as noted above, have one or more identical or non-identical variant PD-L2 of the invention in each polypeptide chain. In some specific embodiments, identical or substantially identical species (allowing for 3 or fewer N-terminus or C-terminus amino acid sequence differences) of PD-L2-Fc variant fusion polypeptides will be dimerized to create a homodimer. Alternatively, different species of PD-L2-Fc variant fusion polypeptides can be dimerized to yield a heterodimer.

In some embodiments, the provided immunomodulatory protein contains at least one additional (e.g., second or, in some cases, also a third IgSF domain and so on) IgSF domain that is a vIgD that contains one or more amino acid substitutions compared to an IgSF domain (e.g. IgV) of a wild-type or unmodified IgSF domain other than PD-L2.

In some embodiments, the one or more additional IgSF domain (e.g. second or third IgSF) domain is an IgSF domain (e.g. IgV) of another IgSF family member that itself also binds to an inhibitory receptor. In some aspects, the one or more additional IgSF domain (e.g. second or third IgSF) domain is an affinity-modified IgSF domain that is a variant IgSF domain (vIgD) of an IgSF family member that bind to an inhibitory receptor and that contains or is a vIgD thereof that contains one or more amino acid substitutions in an IgSF domain (e.g. IgV), in which, in some cases, the one or more amino acid modifications result in increased binding to the inhibitory receptor. In some embodiments, the vIgD contains one or more amino acid modifications (e.g. substitutions, deletions or additions) in a wild-type or unmodified IgSF domain (e.g. IgV) of an IgSF family member that binds to an inhibitory receptor. In addition to PD-1, exemplary of such inhibitory receptors are CTLA-4, LAG3, TIGIT, TIM-3, or BTLA. In some embodiments, the one or more additional IgSF domain is from an IgSF family member selected from CD112, CD155, PD-L1, CD80 or CEACAM1. Thus, in some aspects, provided are multi-target checkpoint antagonists that target or block activity of more than one inhibitory receptor. In some embodiments, the immunomodulatory protein in a multi-target checkpoint antagonist that targets or blocks activity of at least two, three, four or more inhibitory receptors.

In some embodiments, there is provided an immunomodulatory protein containing any one of the variant PD-L2 polypeptides and one or more IgSF domain of an inhibitory receptor, such as a wild-type or unmodified inhibitory receptor. In some embodiments, there is provided an immunomodulatory protein containing any one of the variant PD-L2 polypeptides and one or more IgSF domain of CD80, e.g. wild-type or unmodified CD80, such as an IgV domain set forth in SEQ ID NO:1039, 1113, 2039 or an ECD or a portion thereof (containing the IgV and IgC domain or specific binding fragments thereof) set forth in SEQ ID NO:28 or a portion thereof. In some embodiments, there is provided an immunomodulatory protein containing any one of the variant PD-L2 polypeptides and one or more IgSF domain of PD-L1, e.g. wild-type or unmodified PD-L1, such as an IgV domain set forth in SEQ ID NO: 1258 or 1454 or an ECD or a portion thereof (containing the IgV and IgC domain or specific binding fragments thereof) set forth in SEQ ID NO: 30 or 1812 or a portion thereof. In some embodiments, there is provided an immunomodulatory protein containing any one of the variant PD-L2 polypeptides and one or more IgSF domain of CD112, e.g. wild-type or unmodified CD112, such as an IgV domain set forth in SEQ ID NO: 700 or 795 or an ECD or a portion thereof (containing the IgV and IgC domain or specific binding fragments thereof) set forth in SEQ ID NO:48 or a portion thereof. In some embodiments, there is provided an immunomodulatory protein containing any one of the variant PD-L2 polypeptides and one or more IgSF domain of CD155, e.g. wild-type or unmodified CD155, such as an IgV domain set forth in SEQ ID NO:344 or 387 or an ECD or a portion thereof (containing the IgV and IgC domain or specific binding fragments thereof) set forth in SEQ ID NO:47 or a portion thereof.

In some embodiments, there is provided an immunomodulatory protein containing one or more additional IgSF domain (e.g., second or third IgSF) that is a vIgD of an IgSF family member that binds to an inhibitory receptor in which the one or more amino acid modifications in an IgSF domain (e.g. IgV) results in increased binding affinity of the vIgD, or a fusion or immunomodulatory protein containing the vIgD, for its inhibitory receptor cognate binding partner compared to the unmodified IgSF domain, such as binding affinity that is increased more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In some embodiments, the one or more amino acid modifications in an IgSF domain (e.g. IgV) results in increased selectivity of the vIgD, or a fusion or immunomodulatory protein containing the vIgD for its inhibitory receptor compared to the unmodified IgSF domain. In some embodiments, the increased selectivity is a greater ratio of binding of the vIgD for the inhibitory receptor versus another cognate binding partner, such as a cognate binding partner that is not an inhibitory receptor, compared to the ratio of binding of the unmodified IgSF for the inhibitory receptor versus the another cognate binding partner. In some embodiments, the ratio is greater by at least or at least about 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold.

In some embodiments, the at least one additional (e.g. second or third) vIgD is an IgSF domain (e.g. IgV) of a variant CD80 polypeptide that contains one or more amino acid modifications (e.g. substitutions, deletions or additions) in the IgSF domain (e.g. IgV) compared to unmodified or wild-type of CD80, which, in some aspects, result in increased, binding to the inhibitory receptor CTLA-4. Exemplary amino acid modifications, such as substitutions, deletions or additions, in an IgSF domain (e.g. IgV or ECD containing IgV and IgC) of a variant CD80 polypeptide are set forth in Table 3. In some embodiments, there is provided an immunomodulatory protein containing any of the provided variant PD-L2 polypeptides and a variant CD80 polypeptide containing an IgV domain including any of the amino acid modifications set forth in Table 3, such as the IgV domain set forth in any of SEQ ID NOS: 1040-1072, 1074-1112, 1114-1146, 1148-1186 or an IgV domain that has at least 85%, 86%, 87%, 88%, 89%, 90%, 91%, 92%, 93%, 94%, 95%, 96%, 97%, 98%, 99% to any of SEQ ID NOS: 1040-1072, 1074-1112, 1114-1146, 1148-1186 and contains the one or more amino acid modifications. In some embodiments, there is provided an immunomodulatory protein containing any of the provided variant PD-L2 polypeptides and a variant CD80 polypeptide containing an ECD or a portion thereof containing the IgV and/or IgC domains, in which is contained any of the amino acid modifications set forth in Table 3, such as the ECD set forth in any of SEQ ID NOS: 966-998, 1000-1038 or an ECD that contains at least 85%, 86%, 87%, 88%, 89%, 90%, 91%, 92%, 93%, 94%, 95%, 96%, 97%, 98%, 99% to any of SEQ ID NOS: 966-998, 1000-1038 and contains the one or more amino acid modifications.

In some embodiments, the at least one additional (e.g., second or third) vIgD is an IgSF domain (e.g. IgV) of a variant CD112 polypeptide that contains one or more amino acid modifications (e.g., substitutions, deletions or additions) in the IgSF domain (e.g., IgV) compared to unmodified or wild-type CD112, which, in some aspects, result in increased binding to the inhibitory receptor TIGIT. Exemplary amino acid modifications, such as substitutions, deletions or additions, in an IgSF domain (e.g. IgV or ECD containing IgV and IgC) of a variant CD112 polypeptide are set forth in Table 4. In some embodiments, there is provided an immunomodulatory protein containing any of the provided variant PD-L2 polypeptides and a variant CD112 polypeptide containing an IgV domain including any of the amino acid modifications set forth in Table 4, such as the IgV domain set forth in any of SEQ ID NOS: 748-794, 796-842, 884-965, 1479-1526 or an IgV domain that has at least 85%, 86%, 87%, 88%, 89%, 90%, 91%, 92%, 93%, 94%, 95%, 96%, 97%, 98%, 99% to any of SEQ ID NOS: 748-794, 796-842, 884-965, 1479-1526, and contains the one more amino acid modifications. In some embodiments, there is provided an immunomodulatory protein containing any of the provided variant PD-L2 polypeptides and a variant CD112 polypeptide containing an ECD or a portion thereof containing the IgV and/or IgC domains, in which is contained any of the amino acid modifications set forth in Table 4, such as the ECD set forth in any of SEQ ID NOS: 701-747, 843-883, 1455-1478 or an ECD that contains at least 85%, 86%, 87%, 88%, 89%, 90%, 91%, 92%, 93%, 94%, 95%, 96%, 97%, 98%, 99% to any of SEQ ID NOS: 701-747, 843-883, 1455-1478 and contains the one or more amino acid modifications.

In some embodiments, the at least one additional (e.g., second or third) vIgD is an IgSF domain (e.g. IgV) of a variant CD155 polypeptide that contains one or more amino acid modifications (e.g., substitutions, deletions or additions) in the IgSF domain (e.g., IgV) compared to unmodified or wild-type CD155, which, in some aspects, result in increased binding to the inhibitory receptor TIGIT. Exemplary amino acid modifications, such as substitutions, deletions or additions, in an IgSF domain (e.g. IgV or ECD containing IgV and IgC) of a variant CD155 polypeptide are set forth in Table 5. In some embodiments, there is provided an immunomodulatory protein containing any of the provided variant PD-L2 polypeptides and a variant CD155 polypeptide containing an IgV domain including any of the amino acid modifications set forth in Table 5, such as the IgV domain set forth in any of SEQ ID NOS: 366-386, 388-408, 506-699, 1527-1595, 1597-1598, 1645-1736 or an IgV domain that has at least 85%, 86%, 87%, 88%, 89%, 90%, 91%, 92%, 93%, 94%, 95%, 96%, 97%, 98%, 99% to any of SEQ ID NOS: 366-386, 388-408, 506-699, 1527-1595, 1597-1598, 1645-1736 and contains the one more amino acid modifications. In some embodiments, there is provided an immunomodulatory protein containing any of the provided variant PD-L2 polypeptides and a variant CD155 polypeptide containing an ECD or a portion thereof containing the IgV and/or IgC domains, in which is contained any of the amino acid modifications set forth in Table 5, such as the ECD set forth in any of SEQ ID NOS: 1573-1596, 1599-1644 or an ECD that contains at least 85%, 86%, 87%, 88%, 89%, 90%, 91%, 92%, 93%, 94%, 95%, 96%, 97%, 98%, 99% to any of SEQ ID NOS: 1573-1596, 1599-1644 and contains the one or more amino acid modifications.

In some embodiments, the at least one additional (e.g., second or third) vIgD is an IgSF domain (e.g. IgV) of a variant PD-L1 polypeptide that contains one or more amino acid modifications (e.g., substitutions, deletions or additions) in the IgSF domain (e.g., IgV or ECD) compared to unmodified or wild-type PD-L1, which, in some aspects, result in increased binding to the inhibitory receptor PD-1. Exemplary amino acid modifications, such as substitutions, deletions or additions, in an IgSF domain (e.g. IgV or ECD containing IgV and IgC) of a variant PD-L1 polypeptide are set forth in Table 8. In some embodiments, there is provided an immunomodulatory protein containing any of the provided variant PD-L2 polypeptides and a variant PD-L1 polypeptide containing an IgV domain including any of the amino acid modifications set forth in Table 8, such as the IgV domain set forth in any of SEQ ID NOS: 1324-1453, 1810-1811, 1992-2021, or an IgV domain that has at least 85%, 86%, 87%, 88%, 89%, 90%, 91%, 92%, 93%, 94%, 95%, 96%, 97%, 98%, 99% to any of SEQ ID NOS: 1324-1453, 1810-1811, 1992-2021, and contains the one more amino acid modifications. In some embodiments, there is provided an immunomodulatory protein containing any of the provided variant PD-L2 polypeptides and a variant PD-L1 polypeptide containing an ECD or a portion thereof containing the IgV and/or IgC domains, in which is contained any of the amino acid modifications set forth in Table 8, such as the ECD set forth in any of SEQ ID NOS: 1259-1323, 1743-1809, 1813-1991 or an ECD that contains at least 85%, 86%, 87%, 88%, 89%, 90%, 91%, 92%, 93%, 94%, 95%, 96%, 97%, 98%, 99% to any of SEQ ID NOS: 1259-1323, 1743-1809, 1813-1991, and contains the one or more amino acid modifications.

In some embodiments, the one or more additional IgSF domain (e.g. second or third IgSF) domain is an IgSF domain (e.g. IgV) of another IgSF family member that binds or recognizes a tumor antigen. In such embodiments, the IgSF family member serves as a tumor-localizing moiety, thereby bringing the vIgD of PD-L2 in close proximity to immune cells in the tumor microenvironment. In some embodiments, the additional IgSF domain (e.g. second IgSF) domain is an IgSF domain of NKp30, which binds or recognizes B7-H6 expressed on a tumor cell. In some embodiments, the at least one additional (e.g. second) IgSF domain, e.g. NKp30, is an affinity-modified IgSF domain or vIgD that contains one or more amino acid modifications (e.g. substitutions, deletions or additions). In some embodiments, the one or more amino acid modifications increase binding affinity and/or selectivity to B7-H6 compared to unmodified IgSF domain, e.g. NKp30, such as by at least or at least about 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. Exemplary amino acid modifications, such as substitutions, deletions or additions, in an IgSF domain (e.g. IgC-like or full ECD) of a variant NKp30 polypeptide are set forth in Table 6. Among the exemplary polypeptides is an NKp30 variant that contains the mutations L30V/A60V/S64P/S86G with reference to positions in the NKp30 extracellular domain corresponding to positions set forth in SEQ ID NO: 54. In some embodiments, there is provided an immunomodulatory protein containing any of the provided variant PD-L2 polypeptides and a variant NKp30 polypeptide containing an IgC-like domain including any of the amino acid modifications set forth in Table 6, such as the IgC-like domain set forth in any of SEQ ID NOS: 1232-1236 or an IgC-like domain that has at least 85%, 86%, 87%, 88%, 89%, 90%, 91%, 92%, 93%, 94%, 95%, 96%, 97%, 98%, 99% to any of SEQ ID NOS: 1232-1236 and contains the one more amino acid modifications. In some embodiments, there is provided an immunomodulatory protein containing any of the provided variant PD-L2 polypeptides and a variant NKp30 polypeptide containing an ECD or a portion thereof containing an IgSF domain or domains, in which is contained any of the amino acid modifications set forth in Table 6, such as the ECD set forth in any of SEQ ID NOS: 1226-1230 or an ECD that contains at least 85%, 86%, 87%, 88%, 89%, 90%, 91%, 92%, 93%, 94%, 95%, 96%, 97%, 98%, 99% to any of SEQ ID NOS: 1226-1230 and contains the one or more amino acid modifications.

In some embodiments, the at least one additional (e.g., second or third) vIgD is an IgSF domain (e.g. IgV) of a variant CD86 polypeptide that contains one or more amino acid modifications (e.g., substitutions, deletions or additions) in the IgSF domain (e.g., IgV) compared to unmodified or wild-type CD86, which, in some aspects, result in increased binding to its cognate binding partner. Exemplary amino acid modifications, such as substitutions, deletions or additions, in an IgSF domain (e.g. IgV or ECD containing IgV and IgC) of a variant CD86 polypeptide are set forth in Table 7. Among exemplary polypeptides include CD86 variants that contain the mutations Q35H/H90L/Q102H with reference to positions in the CD86 extracellular domain corresponding to positions set forth in SEQ ID NO: 29. In some embodiments, there is provided an immunomodulatory protein containing any of the provided variant PD-L2 polypeptides and a variant CD86 polypeptide containing an IgV domain including any of the amino acid modifications set forth in Table 7, such as the IgV domain set forth in any of SEQ ID NOS: 1244-1247 or an IgV domain that has at least 85%, 86%, 87%, 88%, 89%, 90%, 91%, 92%, 93%, 94%, 95%, 96%, 97%, 98%, 99% to any of SEQ ID NOS: 1244-1247 and contains the one more amino acid modifications. In some embodiments, there is provided an immunomodulatory protein containing any of the provided variant PD-L2 polypeptides and a variant CD86 polypeptide containing an ECD or a portion thereof containing the IgV and/or IgC domains, in which is contained any of the amino acid modifications set forth in Table 7, such as the ECD set forth in any of SEQ ID NOS: 1239-1242 or an ECD that contains at least 85%, 86%, 87%, 88%, 89%, 90%, 91%, 92%, 93%, 94%, 95%, 96%, 97%, 98%, 99% to any of SEQ ID NOS: 1239-1242 and contains the one or more amino acid modifications.

Tables 3-8 provide exemplary polypeptides containing one or more affinity-modified IgSF domains that can be used in stack constructs provided herein.

TABLE 3

Exemplary variant CD80 polypeptides

| Mutation(s) | ECD SEQ ID NO | IgV SEQ ID NO |
|---|---|---|
| Wild-type | 28 | 1039, 2039 |
| L70P | 966 | 1040, 1114 |
| I30F/L70P | 967 | 1041, 1115 |
| Q27H/T41S/A71D | 968 | 1042, 1116 |
| I30T/L70R | 969 | 1043, 1117 |
| T13R/C16R/L70Q/A71D | 970 | 1044, 1118 |
| T57I | 971 | 1045, 1119 |
| M43I/C82R | 972 | 1046, 1120 |
| V22L/M38V/M47T/A71D/L85M | 973 | 1047, 1121 |
| I30V/T57I/L70P/A71D/A91T | 974 | 1048, 1122 |
| V22I/L70M/A71D | 975 | 1049, 1123 |
| N55D/L70P/E77G | 976 | 1050, 1124 |
| T57A/I69T | 977 | 1051, 1125 |
| N55D/K86M | 978 | 1052, 1126 |
| L72P/T79I | 979 | 1053, 1127 |
| L70P/F92S | 980 | 1054, 1128 |
| T79P | 981 | 1055, 1129 |
| E35D/M47I/L65P/D90N | 982 | 1056, 1130 |
| L25S/E35D/M47I/D90N | 983 | 1057, 1131 |
| A71D | 985 | 1059, 1133 |
| E81K/A91S | 987 | 1061, 1135 |
| A12V/M47V/L70M | 988 | 1062, 1136 |
| K34E/T41A/L72V | 989 | 1063, 1137 |

TABLE 3-continued

Exemplary variant CD80 polypeptides

| Mutation(s) | ECD SEQ ID NO | IgV SEQ ID NO |
|---|---|---|
| T41S/A71D/V84A | 990 | 1064, 1138 |
| E35D/A71D | 991 | 1065, 1139 |
| E35D/M47I | 992 | 1066, 1140 |
| K36R/G78A | 993 | 1067, 1141 |
| Q33E/T41A | 994 | 1068, 1142 |
| M47V/N48H | 995 | 1069, 1143 |
| M47L/V68A | 996 | 1070, 1144 |
| S44P/A71D | 997 | 1071, 1145 |
| Q27H/M43I/A71D/R73S | 998 | 1072, 1146 |
| E35D/T57I/L70Q/A71D | 1000 | 1074, 1148 |
| M47I/E88D | 1001 | 1075, 1149 |
| M42I/I61V/A71D | 1002 | 1076, 1150 |
| P51A/A71D | 1003 | 1077, 1151 |
| H18Y/M47I/T57I/A71G | 1004 | 1078, 1152 |
| V20I/M47V/T57I/V84I | 1005 | 1079, 1153 |
| V20I/M47V/A71D | 1006 | 1080, 1154 |
| A71D/L72V/E95K | 1007 | 1081, 1155 |
| V22L/E35G/A71D/L72P | 1008 | 1082, 1156 |
| E35D/A71D | 1009 | 1083, 1157 |
| E35D/I67L/A71D | 1010 | 1084, 1158 |
| Q27H/E35G/A71D/L72P/T79I | 1011 | 1085, 1159 |
| T13R/M42V/M47I/A71D | 1012 | 1086, 1160 |
| E35D | 1013 | 1087, 1161 |
| E35D/M47I/L70M | 1014 | 1088, 1162 |
| E35D/A71D/L72V | 1015 | 1089, 1163 |
| E35D/M43L/L70M | 1016 | 1090, 1164 |
| A26P/E35D/M43I/L85Q/E88D | 1017 | 1091, 1165 |
| E35D/D46V/L85Q | 1018 | 1092, 1166 |
| Q27L/E35D/M47I/T57I/L70Q/E88D | 1019 | 1093, 1167 |
| M47V/I69F/A71D/V83I | 1020 | 1094, 1168 |
| E35D/T57A/A71D/L85Q | 1021 | 1095, 1169 |
| H18Y/A26T/E35D/A71D/L85Q | 1022 | 1096, 1170 |
| E35D/M47L | 1023 | 1097, 1171 |
| E23D/M42V/M43I/I58V/L70R | 1024 | 1098, 1172 |
| V68M/L70M/A71D/E95K | 1025 | 1099, 1173 |
| N55I/T57I/I69F | 1026 | 1100, 1174 |
| E35D/M43I/A71D | 1027 | 1101, 1175 |
| T41S/T57I/L70R | 1028 | 1102, 1176 |
| H18Y/A71D/L72P/E88V | 1029 | 1103, 1177 |
| V20I/A71D | 1030 | 1104, 1178 |
| E23G/A26S/E35D/T62N/A71D/L72V/L85M | 1031 | 1105, 1179 |
| A12T/E24D/E35D/D46V/I61V/L72P/E95V | 1032 | 1106, 1180 |
| V22L/E35D/M43L/A71G/D76H | 1033 | 1107, 1181 |
| E35D/K54E/A71D/L72P | 1034 | 1108, 1182 |
| L70Q/A71D | 1035 | 1109, 1183 |
| A26E/E35D/M47L/L85Q | 1036 | 1110, 1184 |
| D46E/A71D | 1037 | 1111, 1185 |
| Y31H/E35D/T41S/V68L/K93R/R94W | 1038 | 1112, 1186 |

TABLE 4

Exemplary variant CD112 polypeptides

| Mutation(s) | ECD SEQ ID NO | IgV SEQ ID NO |
|---|---|---|
| Wild-type | 48 | 700, 795 |
| Y33H, A112V, G117D | 701 | 748, 796 |
| V19A, Y33H, S64G, S80G, G98S, N106Y, A112V | 702 | 749, 797 |
| L32P, A112V | 703 | 750, 798 |
| A95V, A112I | 704 | 751, 799 |
| P28S, A112V | 705 | 752, 800 |
| P27A, T38N, V101A, A112V | 706 | 753, 801 |
| S118F | 707 | 754, 802 |
| R12W, H48Y, F54S, S118F | 708 | 755, 803 |
| R12W, Q79R, S118F | 709 | 756, 804 |
| T113S, S118Y | 710 | 757, 805 |
| S118Y | 711 | 758, 806 |

TABLE 4-continued

Exemplary variant CD112 polypeptides

| Mutation(s) | ECD SEQ ID NO | IgV SEQ ID NO |
|---|---|---|
| N106I, S118Y | 712 | 759, 807 |
| N106I, S118F | 713 | 760, 808 |
| A95T, L96P, S118Y | 714 | 761, 809 |
| Y33H, P67S, N106Y, A112V | 715 | 762, 810 |
| N106Y, A112V | 716 | 763, 811 |
| T18S, Y33H, A112V | 717 | 764, 812 |
| P9S, Y33H, N47S, A112V | 718 | 765, 813 |
| P42S, P67H, A112V | 719 | 766, 814 |
| P27L, L32P, P42S, A112V | 720 | 767, 815 |
| G98D, A112V | 721 | 768, 816 |
| Y33H, S35P, N106Y, A112V | 722 | 769, 817 |
| L32P, P42S, T100A, A112V | 723 | 770, 818 |
| P27S, P45S, N106I, A112V | 724 | 771, 819 |
| Y33H, N47K, A112V | 725 | 772, 820 |
| Y33H, N106Y, A112V | 726 | 773, 821 |
| K78R, D84G, A112V, F114S | 727 | 774, 822 |
| Y33H, N47K, F54L, A112V | 728 | 775, 823 |
| Y33H, A112V | 729 | 776, 824 |
| A95V, A112V | 730 | 777, 825 |
| R12W, A112V | 731 | 778, 826 |
| R12W, P27S, A112V | 732 | 779, 827 |
| Y33H, V51M, A112V | 733 | 780, 828 |
| Y33H, A112V, S118T | 734 | 781, 829 |
| Y33H, V101A, A112V, P115S | 735 | 782, 830 |
| H24R, T38N, D43G, A112V | 736 | 783, 831 |
| A112V | 737 | 784, 832 |
| P27A, A112V | 738 | 785, 833 |
| A112V, S118T | 739 | 786, 834 |
| R12W, A112V, M122I | 740 | 787, 835 |
| Q83K, N106Y, A112V | 741 | 788, 836 |
| R12W, P27S, A112V, S118T | 742 | 789, 837 |
| P28S, Y33H, A112V | 743 | 790, 838 |
| P27S, Q90R, A112V | 744 | 791, 839 |
| L15V, P27A, A112V, S118T | 745 | 792, 840 |
| Y33H, N106Y, T108I, A112V | 746 | 793, 841 |
| Y33H, P56L, V75M, V101M, A112V | 747 | 794, 842 |
| N47K, Q79R, S118F | 843 | 884, 925 |
| Q40R, P60T, A112V, S118T | 844 | 885, 926 |
| F114Y, S118F | 845 | 886, 927 |
| Y33H, K78R, S118Y | 846 | 887, 928 |
| R12W, A46T, K66M, Q79R, N106I, T113A, S118F | 847 | 888, 929 |
| Y33H, A112V, S118F | 848 | 889, 930 |
| R12W, Y33H, N106I, S118F | 849 | 890, 931 |
| L15V, Q90R, S118F | 850 | 891, 932 |
| N47K, D84G, N106I, S118Y | 851 | 892, 933 |
| L32P, S118F | 852 | 893, 934 |
| Y33H, Q79R, A112V, S118Y | 853 | 894, 935 |
| T18A, N106I, S118T | 854 | 895, 936 |
| L15V, Y33H, N106Y, A112V, S118F | 855 | 896, 937 |
| V37M, S118F | 856 | 897, 938 |
| N47K, A112V, S118Y | 857 | 898, 939 |
| A46T, A112V | 858 | 899, 940 |
| P28S, Y33H, N106I, S118Y | 859 | 900, 941 |
| P30S, Y33H, N47K, V75M, Q79R, N106I, S118Y | 860 | 901, 942 |
| V19A, N47K, N106Y, K116E, S118Y | 861 | 902, 943 |
| Q79R, T85A, A112V, S118Y | 862 | 903, 944 |
| V101M, N106I, S118Y | 863 | 904, 945 |
| Y33H, Q79R, N106I, A112V, S118T | 864 | 905, 946 |
| Q79R, A112V | 865 | 906, 947 |
| Y33H, A46T, Q79R, N106I, S118F | 866 | 907, 948 |
| A112V, G121S | 867 | 908, 949 |
| Y33H, Q79R, N106I, S118Y | 868 | 909, 950 |
| Y33H, N106I, A112V | 869 | 910, 951 |
| Y33H, A46T, V101M, A112V, S118T | 870 | 911, 952 |
| L32P, L99M, N106I, S118F | 871 | 912, 953 |
| L32P, T108A, S118F | 872 | 913, 954 |
| R12W, Q79R, A112V | 873 | 914, 955 |
| Y33H, N106Y, E110G, A112V | 874 | 915, 956 |
| Y33H, N106I, S118Y | 875 | 916, 957 |
| Q79R, S118F | 876 | 917, 958 |
| Y33H, Q79R, G98D, V101M, A112V | 877 | 918, 959 |
| N47K, T81S, V101M, A112V, S118F | 878 | 919, 960 |
| G82S, S118Y | 879 | 920, 961 |

TABLE 4-continued

Exemplary variant CD112 polypeptides

| Mutation(s) | ECD SEQ ID NO | IgV SEQ ID NO |
|---|---|---|
| Y33H, A112V, S118Y | 880 | 921, 962 |
| Y33H, N47K, Q79R, N106Y, A112V | 881 | 922, 963 |
| Y33H, S118T | 882 | 923, 964 |
| R12W, Y33H, Q79R, V101M, A112V | 883 | 924, 965 |
| Y33H, Q83K, A112V, S118T | 1455 | 1479, 1503 |
| V29M, Y33H, N106I, S118F | 1456 | 1480, 1504 |
| Y33H, A46T, A112V | 1457 | 1481, 1505 |
| Y33H, Q79R, S118F | 1458 | 1482, 1506 |
| Y33H, N47K, F74L, S118F | 1459 | 1483, 1507 |
| R12W, V101M, N106I, S118Y | 1460 | 1484, 1508 |
| A46T, V101A, N106I, S118Y | 1461 | 1485, 1509 |
| N106Y, A112V, S118T | 1462 | 1486, 1510 |
| S76P, T81I, V101M, N106Y, A112V, S118F | 1463 | 1487, 1511 |
| P9R, L21V, P22L, I34M, S69F, F74L, A87V, A112V, L125A | 1464 | 1488, 1512 |
| Y33H, V101M, A112V | 1465 | 1489, 1513 |
| V29A, L32P, S118F | 1466 | 1490, 1514 |
| Y33H, V101M, N106I, A112V | 1467 | 1491, 1515 |
| R12W, Y33H, N47K, Q79R, S118Y | 1468 | 1492, 1516 |
| Y33H, A46T, A112V, S118T | 1469 | 1493, 1517 |
| Y33H, A112V, F114L, S118T | 1470 | 1494, 1518 |
| Y33H, T38A, A46T, V101M, A112V | 1471 | 1495, 1519 |
| P28S, Y33H, S69P, N106I, A112V, S118Y | 1472 | 1496, 1520 |
| Y33H, P42L, N47K, V101M, A112V | 1473 | 1497, 1521 |
| Y33H, N47K, F74S, Q83K, N106I, F111L, A112V, S118T | 1474 | 1498, 1522 |
| Y33H, A112V, S118T, V119A | 1475 | 1499, 1523 |
| Y33H, N106I, A112V, S118F | 1476 | 1500, 1524 |
| Y33H, K66M, S118F, W124L | 1477 | 1501, 1525 |
| N106I, A112V | 1478 | 1502, 1526 |

TABLE 5

Exemplary variant CD155 polypeptides

| Mutation(s) | ECD SEQ ID NO | IgV SEQ ID NO |
|---|---|---|
| Wild-type | 47 | 344, 387 |
| P18S, P64S, F91S | 345 | 366, 388 |
| P18S, F91S, L104P | 346 | 367, 389 |
| L44P | 347 | 368, 390 |
| A56V | 348 | 369, 391 |
| P18L, L79V, F91S | 349 | 370, 392 |
| P18S, F91S | 350 | 371, 393 |
| P18T, F91S | 351 | 372, 394 |
| P18T, S42P, F91S | 352 | 373, 395 |
| G7E, P18T, Y30C, F91S | 353 | 374, 396 |
| P18T, F91S, G111D | 354 | 375, 397 |
| P18S, F91P | 355 | 376, 398 |
| P18T, F91S, F108L | 356 | 377, 399 |
| P18T, T45A, F91S | 357 | 378, 400 |
| P18T, F91S, R94H | 358 | 379, 401 |
| P18S, Y30C, F91S | 359 | 380, 402 |
| A81V, L83P | 360 | 381, 403 |
| L88P | 361 | 382, 404 |
| R94H | 362 | 383, 405 |
| A13E, P18S, A56V, F91S | 363 | 384, 406 |
| P18T, F91S, V115A | 364 | 385, 407 |
| P18T, Q60K | 365 | 386, 408 |
| S52M | 409 | 506, 603 |
| T45Q, S52L, L104E, G111R | 410 | 507, 604 |
| S42G | 411 | 508, 605 |
| Q62F | 412 | 509, 606 |
| S52Q | 413 | 510, 607 |
| S42A, L104Q, G111R | 414 | 511, 608 |
| S42A, S52Q, L104Q, G111R | 415 | 512, 609 |
| S52W, L104E | 416 | 513, 610 |
| S42C | 417 | 514, 611 |

TABLE 5-continued

Exemplary variant CD155 polypeptides

| Mutation(s) | ECD SEQ ID NO | IgV SEQ ID NO |
|---|---|---|
| S52W | 418 | 515, 612 |
| S52M, L104Q | 419 | 516, 613 |
| S42L, S52L, Q62F, L104Q | 420 | 517, 614 |
| S42W | 421 | 518, 615 |
| S42Q | 422 | 519, 616 |
| S52L | 423 | 520, 617 |
| S52R | 424 | 521, 618 |
| L104E | 425 | 522, 619 |
| G111R | 426 | 523, 620 |
| S52E | 427 | 524, 621 |
| Q62Y | 428 | 525, 622 |
| T45Q, S52M, L104E | 429 | 526, 623 |
| S42N, L104Q, G111R | 430 | 527, 624 |
| S52M, V57L | 431 | 528, 625 |
| S42N, S52Q, Q62F | 432 | 529, 626 |
| S42A, S52L, L104E, G111R | 433 | 530, 627 |
| S42W, S52Q, V57L, Q62Y | 434 | 531, 628 |
| L104Q | 435 | 532, 629 |
| S42L, S52Q, L104E | 436 | 533, 630 |
| S42C, S52L | 437 | 534, 631 |
| S42W, S52R, Q62Y, L104Q | 438 | 535, 632 |
| T45Q, S52R, L104E | 439 | 536, 633 |
| S52R, Q62F, L104Q, G111R | 440 | 537, 634 |
| T45Q, S52L, V57L, L104E | 441 | 538, 635 |
| S52M, Q62Y | 442 | 539, 636 |
| Q62F, L104E, G111R | 443 | 540, 637 |
| T45Q, S52Q | 444 | 541, 638 |
| S52L, L104E | 445 | 542, 639 |
| S42V, S52E | 446 | 543, 640 |
| T45Q, S52R, G111R | 447 | 544, 641 |
| S42G, S52Q, L104E, G111R | 448 | 545, 642 |
| S42N, S52E, V57L, L104E | 449 | 546, 643 |
| S42C, S52M, Q62F | 450 | 547, 644 |
| S42L | 451 | 548, 645 |
| S42A | 452 | 549, 646 |
| S42G, S52L, Q62F, L104Q | 453 | 550, 647 |
| S42N | 454 | 551, 648 |
| P18T, S65A, S67V, F91S | 455 | 552, 649 |
| P18F, T39A, T45Q, T61R, S65N, S67L, E73G, R78G | 456 | 553, 650 |
| P18T, T45Q, T61R, S65N, S67L | 457 | 554, 651 |
| P18F, S65A, S67V, F91S | 458 | 555, 652 |
| P18F, T45Q, T61R, S65N, S67L, F91S, L104P | 459 | 556, 653 |
| P18S, L79P, L104M | 460 | 557, 654 |
| P18S, L104M | 461 | 558, 655 |
| L79P, L104M | 462 | 559, 656 |
| P18T, T45Q, L79P | 463 | 560, 657 |
| P18T, T45Q, T61R, S65H, S67H | 464 | 561, 658 |
| P18T, A81E | 465 | 562, 659 |
| P18S, D23Y, E37P, S52G, Q62M, G80S, A81P, G99Y, S112N | 466 | 563, 660 |
| A13R, D23Y, E37P, S42P, Q62Y, A81E | 467 | 564, 661 |
| A13R, D23Y, E37P, G99Y, S112N | 468 | 565, 662 |
| A13R, D23Y, E37P, Q62M, A77V, G80S, A81P, G99Y | 469 | 566, 663 |
| P18L, E37S, Q62M, G80S, A81P, G99Y, S112N | 470 | 567, 664 |
| P18S, L104T | 471 | 568, 665 |
| P18S, Q62H, L79Q, F91S | 472 | 569, 666 |
| T45Q, S52K, Q62F, L104Q, G111R | 473 | 570, 667 |
| T45Q, S52Q, Q62Y, L104Q, G111R | 474 | 571, 668 |
| T45Q, S52Q, Q62Y, L104E, G111R | 475 | 572, 669 |
| V57A, T61M, S65W, S67A, E96D, L104T | 476 | 573, 670 |
| P18L, V57T, T61S, S65Y, S67A, L104T | 477 | 574, 671 |
| P18T, T45Q | 478 | 575, 672 |
| P18L, V57A, T61M, S65W, S67A, L104T | 479 | 576, 673 |
| T61M, S65W, S67A, L104T | 480 | 577, 674 |
| P18S, V41A, S42G, T45G, L104N | 481 | 578, 675 |
| P18H, S42G, T451, S52T, G53R, S54H, V57L, H59E, T61S, S65D, E68G, L104N | 482 | 579, 676 |
| P18S, S42G, T45V, F58L, S67W, L104N | 483 | 580, 677 |
| P18S, T45I, L104N | 484 | 581, 678 |
| P18S, S42G, T45G, L104N, V106A | 485 | 582, 679 |
| P18H, H40R, S42G, T45I, S52T, G53R, S54H, V57L, H59E, T61S, S65D, E68G, L104Y, V106L, F108H | 486 | 583, 680 |
| E37V, S42G, T45G, L104N | 487 | 584, 681 |
| P18S, T45Q, L79P, L104T | 488 | 585, 682 |
| P18L, Q62R | 489 | 586, 683 |

TABLE 5-continued

| Exemplary variant CD155 polypeptides | | |
|---|---|---|
| Mutation(s) | ECD SEQ ID NO | IgV SEQ ID NO |
| A13R, D23Y, E37P, S42L, S52G, Q62Y, A81E | 490 | 587, 684 |
| P18L, H49R, L104T, D116N | 491 | 588, 685 |
| A13R, D23Y, E37P, Q62M, G80S, A81P, L104T | 492 | 589, 686 |
| S65T, L104T | 493 | 590, 687 |
| A13R, D23Y, E37P, S52G, V57A, Q62M, K70E, L104T | 494 | 591, 688 |
| P18L, A47V, Q62Y, E73D, L104T | 495 | 592, 689 |
| H40T, V41M, A47V, S52Q, Q62L, S65T, E73R, D97G, E98S, L104T, D116N | 496 | 593, 690 |
| P18L, S42P, T45Q, T61G, S65H, S67E, L104T, D116N | 497 | 594, 691 |
| P18S, H40T, V41M, A47V, S52Q, Q62L, S65T, E73R, L104M, V106A | 498 | 595, 692 |
| H40T, V41M, A47V, S52Q, Q62L, S65T, E68G, E73R, D97G, E98S, L104T | 499 | 596, 693 |
| T45Q, S52E, L104E | 500 | 597, 694 |
| T45Q, S52E, Q62F, L104E | 501 | 598, 695 |
| P18F, T26M, L44V, Q62K, L79P, F91S, L104M, G111D | 502 | 599, 696 |
| P18S, T45S, T61K, S65W, S67A, F91S, G111R | 503 | 600, 697 |
| P18S, L79P, L104M, T107M | 504 | 601, 698 |
| P18S, S65W, S67A, M90V, V95A, L104Q, G111R | 505 | 602, 699 |
| P18S, A47G, L79P, F91S, L104M, T107A, R113W | 1573 | 1527, 1550 |
| P18T, D23G, S24A, N35D, H49L, L79P, F91S, L104M, G111R | 1574 | 1528, 1551 |
| V9L, P18S, Q60R, V75L, L79P, R89K, F91S, L104E, G111R | 1575 | 1529, 1552 |
| P18S, H49R, E73D, L79P, N85D, F91S, V95A, L104M, G111R | 1576 | 1530, 1553 |
| V11A, P18S, L79P, F91S, L104M, G111R | 1577 | 1531, 1554 |
| V11A, P18S, S54R, Q60P, Q62K, L79P, N85D, F91S, T107M | 1578 | 1532, 1555 |
| P18T, S52P, S65A, S67V, L79P, F91S, L104M, G111R | 1579 | 1533, 1556 |
| P18T, M36T, L79P, F91S, G111R | 1580 | 1534, 1557 |
| D8G, P18S, M36I, V38A, H49Q, A76E, F91S, L104M, T107A, R113W | 1581 | 1535, 1558 |
| P18S, S52P, S65A, S67V, L79P, F91S, L104M, T107S, R113W | 1582 | 1536, 1559 |
| T15I, P18T, L79P, F91S, L104M, G111R | 1583 | 1537, 1560 |
| P18F, T26M, L44V, Q62K, L79P, E82D, F91S, L104M, G111D | 1584 | 1538, 1561 |
| P18T, E37G, G53R, Q62K, L79P, F91S, E98D, L104M, T107M | 1585 | 1539, 1562 |
| P18L, K70E, L79P, F91S, V95A, G111R | 1586 | 1540, 1563 |
| V9I, Q12K, P18F, S65A, S67V, L79P, L104T, G111R, S112I | 1587 | 1541, 1564 |
| P18F, S65A, S67V, F91S, L104M, G111R | 1588 | 1542, 1565 |
| V9I, V10I, P18S, F20S, T45A, L79P, F91S, L104M, F108Y, G111R, S112V | 1589 | 1543, 1566 |
| V9L, P18L, L79P, M90I, F91S, T102S, L104M, G111R | 1590 | 1544, 1567 |
| P18C, T26M, L44V, M55I, Q62K, L79P, F91S, L104M, T107M | 1591 | 1545, 1568 |
| V9I, P18T, D23G, L79P, F91S, G111R | 1592 | 1546, 1569 |
| P18F, L79P, M90L, F91S, V95A, L104M, G111R | 1593 | 1547, 1570 |
| P18T, M36T, S65A, S67E, L79Q, A81T, F91S, G111R | 1594 | 1548, 1571 |
| V9L, P18T, Q62R, L79P, F91S, L104M, G111R | 1595 | 1549, 1572 |
| P18S, S65W, S67A, L104Q, G111R | 1596 | 1597, 1598 |
| P18T, G19D, M36T, S54N, L79P, L83Q, F91S, T107M, F108Y | 1599 | 1645, 1691 |
| V9L, P18L, M55V, S69L, L79P, A81E, F91S, T107M | 1600 | 1646, 1692 |
| P18F, H40Q, T61K, Q62K, L79P, F91S, L104M, T107V | 1601 | 1647, 1693 |
| P18S, Q32R, Q62K, R78G, L79P, F91S, T107A, R113W | 1602 | 1648, 1694 |
| Q12H, P18T, L21S, G22S, V57A, Q62R, L79P, F91S, T107M | 1603 | 1649, 1695 |
| V9I, P18S, S24P, H49Q, F58Y, Q60R, Q62K, L79P, F91S, T107M | 1604 | 1650, 1696 |
| P18T, W46C, H49R, S65A, S67V, A76T, L79P, S87T, L104M | 1605 | 1651, 1697 |
| P18S, S42T, E51G, L79P, F91S, G92W, T107M | 1606 | 1652, 1698 |
| V10F, T15S, P18L, R48Q, L79P, F91S, T107M, V115M | 1607 | 1653, 1699 |
| P18S, L21M, Y30F, N35D, R84W, F91S, T107M, D116G | 1608 | 1654, 1700 |
| P18F, E51V, S54G, Q60R, L79Q, E82G, S87T, M90I, F91S, G92R, T107M | 1609 | 1655, 1701 |
| Q16H, P18F, F91S, T107M | 1610 | 1656, 1702 |
| P18T, D23G, Q60R, S67L, L79P, F91S, T107M, V115A | 1611 | 1657, 1703 |
| D8G, V9I, V11A, P18T, T26M, S52P, L79P, F91S, G92A, T107L, V115A | 1612 | 1658, 1704 |
| V9I, P18F, A47E, G50S, E68G, L79P, F91S, T107M | 1613 | 1659, 1705 |
| P18S, M55I, Q62K, S69P, L79P, F91S, T107M | 1614 | 1660, 1706 |
| P18T, T39S, S52P, S54R, L79P, F91S, T107M | 1615 | 1661, 1707 |
| P18S, D23N, L79P, F91S, T107M, S114N | 1616 | 1662, 1708 |
| P18S, P34S, E51V, L79P, F91S, G111R | 1617 | 1663, 1709 |
| P18S, H59N, V75A, L79P, A81T, F91S, L104M, T107M | 1618 | 1664, 1710 |
| P18S, W46R, E68D, L79P, F91S, T107M, R113G | 1619 | 1665, 1711 |
| V9L, P18F, T45A, S65A, S67V, R78K, L79V, F91S, T107M, S114T | 1620 | 1666, 1712 |
| P18T, M55L, T61R, L79P, F91S, V106I, T107M | 1621 | 1667, 1713 |
| T15I, P18S, V33M, N35F, T39S, M55L, R78S, L79P, F91S, T107M | 1622 | 1668, 1714 |
| P18S, Q62K, K70E, L79P, F91S, G92E, R113W | 1623 | 1669, 1715 |
| P18F, F20I, T26M, A47V, E51K, L79P, F91S | 1624 | 1670, 1716 |
| P18T, D23A, Q60H, L79P, M90V, F91S, T107M | 1625 | 1671, 1717 |

TABLE 5-continued

Exemplary variant CD155 polypeptides

| Mutation(s) | ECD SEQ ID NO | IgV SEQ ID NO |
|---|---|---|
| P18S, D23G, C29R, N35D, E37G, M55I, Q62K, S65A, S67G, R78G, L79P, F91S, L104M, T107M, Q110R | 1626 | 1672, 1718 |
| A13E, P18S, M36R, Q62K, S67T, L79P, N85D, F91S, T107M | 1627 | 1673, 1719 |
| V9I, P18T, H49R, L79P, N85D, F91S, L104T, T107M | 1628 | 1674, 1720 |
| V9A, P18F, T61S, Q62L, L79P, F91S, G111R | 1629 | 1675, 1721 |
| D8E, P18T, T61A, L79P, F91S, T107M | 1630 | 1676, 1722 |
| P18S, V41A, H49R, S54C, L79S, N85Y, L88P, F91S, L104M, T107M | 1631 | 1677, 1723 |
| V11E, P18H, F20Y, V25E, N35S, H49R, L79P, F91S, T107M, G111R | 1632 | 1678, 1724 |
| V11A, P18F, D23A, L79P, G80D, V95A, T107M | 1633 | 1679, 1725 |
| P18S, K70R, L79P, F91S, G111R | 1634 | 1680, 1726 |
| V9L, V11M, P18S, N35S, S54G, Q62K, L79P, L104M, T107M, | 1635 | 1681, 1727 |
| V9L, P18Y, V25A, V38G, M55V, A77T, L79P, M90I, F91S, L104M | 1636 | 1682, 1728 |
| V10G, P18T, L72Q, L79P, F91S, T107M | 1637 | 1683, 1729 |
| P18S, H59R, A76G, R78S, L79P | 1638 | 1684, 1730 |
| V9A, P18S, M36T, S65G, L79P, F91S, L104T, G111R, S112I | 1639 | 1685, 1731 |
| P18T, S52A, V57A, Q60R, Q62K, S65C, L79P, F91T, N100Y, T107M | 1640 | 1686, 1732 |
| V11A, P18F, N35D, A47E, Q62K, L79P, F91S, G99D, T107M, S114N | 1641 | 1687, 1733 |
| V11A, P18T, N35S, L79P, S87T, F91S | 1642 | 1688, 1734 |
| V9D, V11M, Q12L, P18S, E37V, M55I, Q60R, K70Q, L79P, F91S, L104M, T107M | 1643 | 1689, 1735 |
| T15S, P18S, Y30H, Q32L, Q62R, L79P, F91S, T107M | 1644 | 1690, 1736 |

TABLE 6

Exemplary variant NKp30 polypeptides

| Mutation(s) | ECD SEQ ID NO | IgC-like domain SEQ ID NO |
|---|---|---|
| Wild-type | 54 | 1231, 1238 |
| L30V/A60V/S64P/S86G | 1226 | 1232 |
| L30V | 1227 | 1233 |
| A60V | 1228 | 1234 |
| S64P | 1229 | 1235 |
| S86G | 1230 | 1236 |

TABLE 7

Exemplary variant CD86 polypeptides

| Mutation(s) | ECD SEQ ID NO | IgV SEQ ID NO |
|---|---|---|
| Wild-type | 29 | 1243 |
| Q35H/H9OL/Q102H | 1239 | 1244 |
| Q35H | 1240 | 1245 |
| H90L | 1241 | 1246 |
| Q102H | 1242 | 1247 |

TABLE 8

Exemplary variant PD-L1 polypeptides

| Mutation(s) | ECD SEQ ID NO | IgV SEQ ID NO |
|---|---|---|
| Wild-type | 30, 1812 | 1258, 1454 |
| K28N/M41V/N45T/H51N/K57E | 1259, 1743 | 1324, 1389 |
| I20L/I36T/N45D/I47T | 1260, 1744 | 1325, 1390 |
| I20L/M41K/K44E | 1261, 1745 | 1326, 1391 |
| P6S/N45T/N78I/I83T | 1262, 1746 | 1327, 1392 |
| N78I | 1263, 1747 | 1328, 1393 |
| M41K/N78I | 1264, 1748 | 1329, 1394 |
| N45T/N78I | 1265, 1749 | 1330, 1395 |
| I20L/N45T | 1266, 1750 | 1331, 1396 |
| N45T | 1267, 1751 | 1332, 1397 |
| M41K | 1268, 1752 | 1333, 1398 |
| I20L/I36T/N45D | 1269, 1753 | 1334, 1399 |
| N17D/N45T/V50A/D72G | 1270, 1754 | 1335, 1400 |
| I20L/F49S | 1271, 1755 | 1336, 1401 |
| N45T/V50A | 1272, 1756 | 1337, 1402 |
| I20L/N45T/N78I | 1273, 1757 | 1338, 1403 |
| I20L/N45T/V50A | 1274, 1758 | 1339, 1404 |
| M41V/N45T | 1275, 1759 | 1340, 1405 |
| M41K/N45T | 1276, 1760 | 1341, 1406 |
| A33D/S75P/D85E | 1277, 1761 | 1342, 1407 |
| M181/M41K/D43G/H51R/N781 | 1278, 1762 | 1343, 1408 |
| V11E/I20L/I36T/N45D/H60R/S75P | 1279, 1763 | 1344, 1409 |
| A33D/V50A | 1280, 1764 | 1345, 1410 |
| S16G/A33D/K71E/S75P | 1281, 1765 | 1346, 1411 |
| E27G/N45T/M97I | 1282, 1766 | 1347, 1412 |
| E27G/N45T/K57R | 1283, 1767 | 1348, 1413 |
| A33D/E53V | 1284, 1768 | 1349, 1414 |
| D43G/N45D/V58A | 1285, 1769 | 1350, 1415 |
| E40G/D43V/N45T/V50A | 1286, 1770 | 1351, 1416 |
| Y14S/K28E/N45T | 1287, 1771 | 1352, 1417 |
| A33D/N78S | 1288, 1772 | 1353, 1418 |
| A33D/N78I | 1289, 1773 | 1354, 1419 |
| A33D/N45T | 1290, 1774 | 1355, 1420 |
| A33D/N45T/N78I | 1291, 1775 | 1356, 1421 |
| E27G/N45T/V50A | 1292, 1776 | 1357, 1422 |
| N45T/V50A/N78S | 1293, 1777 | 1358, 1423 |

TABLE 8-continued

Exemplary variant PD-L1 polypeptides

| Mutation(s) | ECD SEQ ID NO | IgV SEQ ID NO |
|---|---|---|
| I20L/N45T/V110M | 1294, 1778 | 1359, 1424 |
| I20L/I36T/N45T/V50A | 1295, 1779 | 1360, 1425 |
| N45T/L74P/S75P | 1296, 1780 | 1361, 1426 |
| N45T/S75P | 1297, 1781 | 1362, 1427 |
| S75P/K106R | 1298, 1782 | 1363, 1428 |
| S75P | 1299, 1783 | 1364, 1429 |
| A33D/S75P | 1300, 1784 | 1365, 1430 |
| A33D/S75P/D104G | 1301, 1785 | 1366, 1431 |
| A33D/S75P | 1302, 1786 | 1367, 1432 |
| I20L/E27G/N45T/V50A | 1303, 1787 | 1368, 1433 |
| I20L/E27G/D43G/N45D/V58A/N78I | 1304, 1788 | 1369, 1434 |
| I20L/D43G/N45D/V58A/N78I | 1305, 1789 | 1370, 1435 |
| I20L/A33D/D43G/N45D/V58A/N78I | 1306, 1790 | 1371, 1436 |
| I20L/D43G/N45D/N78I | 1307, 1791 | 1372, 1437 |
| E27G/N45T/V50A/N78I | 1308, 1792 | 1373, 1438 |
| N45T/V50A/N78I | 1309, 1793 | 1374, 1439 |
| V11A/I20L/E27G/D43G/N45D/H51Y/S99G | 1310, 1794 | 1375, 1440 |
| I20L/E27G/D43G/N45T/V50A | 1311, 1795 | 1376, 1441 |
| I20L/K28E/D43G/N45D/V58A/Q89R | 1312, 1796 | 1377, 1442 |
| I20L/I36T/N45D | 1313, 1797 | 1378, 1443 |
| I20L/K28E/D43G/N45D/E53G/V58A/N78I | 1314, 1798 | 1379, 1444 |
| A33D/D43G/N45D/V58A/S75P | 1315, 1799 | 1380, 1445 |
| K23R/D43G/N45D | 1316, 1800 | 1381, 1446 |
| I20L/D43G/N45D/V58A/N78I/D90G/G101D | 1317, 1801 | 1382, 1447 |
| D43G/N45D/L56Q/V58A/G101G-ins(G101GG) | 1318, 1802 | 1383, 1448 |
| I20L/K23E/D43G/N45D/V58A/N78I | 1319, 1803 | 1384, 1449 |
| I20L/K23E/D43G/N45D/V50A/N78I | 1320, 1804 | 1385, 1450 |
| T19I/E27G/N45I/V50A/N78I/M97K | 1321, 1805 | 1386, 1451 |
| I20L/M41K/D43G/N45D | 1322, 1806 | 1387, 1452 |
| K23R/N45T/N78I | 1323, 1807 | 1388, 1453 |
| I20L/K28E/D43G/N45D/V58A/Q89R/G101G-ins (G101GG) | 1808, 1809 | 1810, 1811 |
| K57R/S99G | 1813, 1903 | 1992, 2007 |
| K57R/S99G/F189L | 1814, 1904 | |
| M18V/M97L/F193S/R195G/E200K/H202Q | 1815, 1905 | |
| I36S/M41K/M97L/K144Q/R195G/E200K/H202Q/L206F | 1816, 1906 | |
| C22R/Q65L/L124S/K144Q/R195G/E200N/H202Q/T221L | 1817 | |
| M18V/I98L/L124S/P198T/L206F | 1818, 1907 | |
| S99G/N117S/I148V/K171R/R180S | 1819, 1908 | |
| I36T/M97L/A103V/Q155H | 1820, 1909 | |
| K28I/S99G | 1821, 1910 | 1993, 2008 |
| R195S | 1822, 1911 | |
| A79T/S99G/T185A/R195G/E200K/H202Q/L206F | 1823, 1912 | |
| K57R/S99G/L124S/K144Q | 1824, 1913 | |
| K57R/S99G/R195G | 1825, 1914 | |
| D55V/M97L/S99G | 1826, 1915 | 1994, 2009 |
| E27G/I36T/D55N/M97L/K111E | 1827, 1916 | 1995, 2010 |
| E54G/M97L/S99G | 1828, 1917 | 1996, 2011 |
| G15A/I36T/M97L/K111E/H202Q | 1829, 1918 | |
| G15A/I36T/V129D | 1830, 1919 | |
| G15A/I36T/V129D/R195G | 1831, 1920 | |
| G15A/V129D | 1832, 1921 | |
| I36S/M97L | 1833, 1922 | 1997, 2012 |
| I36T/D55N/M97L/K111E/A204T | 1834, 1923 | |
| I36T/D55N/M97L/K111E/V129A/F173L | 1835, 1924 | |
| I36T/D55S/M97L/K111E/I148V/R180S | 1836, 1925 | |
| I36T/G52R/M97L/V112A/K144E/V175A/P198T | 1837, 1926 | |
| I36T/I46V/D55G/M97L/K106E/K144E/T185A/R195G | 1838, 1927 | |
| I36T/I83T/M97L/K144E/P198T | 1839, 1928 | |
| I36T/M97L/K111E | 1840, 1929 | 1998, 2013 |
| I36T/M97L/K144E/P198T | 1841, 1930 | |
| I36T/M97L/Q155H/F193S/N201Y | 1842, 1931 | |
| I36T/M97L/V129D | 1843, 1932 | |
| L35P/I36S/M97L/K111E | 1844, 1933 | 1999, 2014 |
| M18I/I36T/E53G/M97L/K144E/E199G/V207A | 1845, 1934 | |
| M18I/I36T/D55N/M97L/K111E | 1846, 1935 | 2000, 2015 |
| M18V/M97L/T176N/R195G | 1847, 1936 | |
| M97L/S99G | 1848, 1937 | 2001, 2016 |
| N17D/M97L/S99G | 1849, 1938 | 2002, 2017 |
| S99G/T185A/R195G/P198T | 1850, 1939 | |
| V129D/H202Q | 1851, 1940 | |
| V129D/P198T | 1852, 1941 | |
| V129D/T150A | 1853, 1942 | |
| V93E/V129D | 1854, 1943 | |
| Y10F/M18V/S99G/Q138R/T203A | 1855, 1944 | |
| N45D | 1856, 1945 | 2003, 2018 |
| K160M/R195G | 1857, 1946 | |
| N45D/K144E | 1858, 1947 | |
| N45D/P198S | 1859, 1948 | |
| N45D/P198T | 1860, 1949 | |
| N45D/R195G | 1861, 1950 | |
| N45D/R195S | 1862, 1951 | |
| N45D/S131F | 1863, 1952 | |
| N45D/V58D | 1864, 1953 | 2004, 2019 |
| V129D/R195S | 1865, 1954 | |
| I98T/F173Y/L196S | 1866, 1955 | |
| N45D/E134G/L213P | 1867, 1956 | |
| N45D/F173I/S177C | 1868, 1957 | |
| N45D/I148V/R195G | 1869, 1958 | |
| N45D/K111T/R195G | 1870, 1959 | |
| N45D/N113Y/R195S | 1871, 1960 | |
| N45D/N165Y/E170G | 1872, 1961 | |
| N45D/Q89R/I98V | 1873, 1962 | 2005, 2020 |
| N45D/S131F/P198S | 1874, 1963 | |
| N45D/S75P/P198S | 1875, 1964 | |
| N45D/V50A/R195T | 1876, 1965 | |
| E27D/N45D/T183A/I188V | 1877, 1966 | |
| F173Y/T183I/L196S/T203A | 1878, 1967 | |
| K23N/N45D/S75P/N120S | 1879, 1968 | |
| N45D/G102D/R194W/R195G | 1880, 1969 | |
| N45D/G52V/Q121L/P198S | 1881, 1970 | |
| N45D/I148V/R195G/N201D | 1882, 1971 | |
| N45D/K111T/T183A/I188V | 1883, 1972 | |
| N45D/Q89R/F189S/P198S | 1884, 1973 | |
| N45D/S99G/C137R/V207A | 1885, 1974 | |
| N45D/T163I/K167R/R195G | 1886, 1975 | |
| N45D/T183A/T192S/R194G | 1887, 1976 | |
| N45D/V50A/I119V/K144E | 1888, 1977 | |
| T19A/N45D/K144E/R195G | 1889, 1978 | |
| V11E/N45D/T130A/P198T | 1890, 1979 | |
| V26A/N45D/T163I/T185A | 1891, 1980 | |
| K23N/N45D/L124S/K167T/R195G | 1892, 1981 | |
| K23N/N45D/Q73R/T163I | 1893, 1982 | |
| K28E/N45D/W149R/S158G/P198T | 1894, 1983 | |
| K28R/N45D/K57E/I98V/R195S | 1895, 1984 | |
| K28R/N45D/V129D/T163N/R195T | 1896, 1985 | |
| M41K/D43G/N45D/R64S/R195G | 1897, 1986 | |
| M41K/D43G/N45D/R64S/S99G | 1898, 1987 | 2006, 2021 |
| N45D/R68L/F173L/D197G/P198S | 1899, 1988 | |
| N45D/V50A/I148V/R195G/N201D | 1900, 1989 | |
| M41K/D43G/K44E/N45D/R195G/N201D | 1901, 1990 | |
| N45D/V50A/L124S/K144E/L179P/R195G | 1902, 1991 | |

The number of such non-affinity modified or affinity modified IgSF domains present in a "stacked" immunomodulatory protein construct (whether non-wild type combinations or non-wild type arrangements) is at least 2, 3, 4, or 5 and in some embodiments exactly 2, 3, 4, or 5 IgSF domains (whereby determination of the number of affinity modified IgSF domains disregards any non-specific binding fractional sequences thereof and/or substantially immunologically inactive fractional sequences thereof).

In some embodiments of a stacked immunomodulatory protein provided herein, the number of IgSF domains is at least 2 wherein the number of affinity modified and the number of non-affinity modified IgSF domains is each independently at least: 0, 1, 2, 3, 4, 5, or 6. Thus, the number of affinity modified IgSF domains and the number of non-affinity modified IgSF domains, respectively, (affinity modified IgSF domain: non-affinity modified IgSF domain), can be exactly or at least: 2:0 (affinity modified: wild-type), 0:2, 2:1, 1:2, 2:2, 2:3, 3:2, 2:4, 4:2, 1:1, 1:3, 3:1, 1:4, 4:1, 1:5, or 5:1.

In some embodiments of a stacked immunomodulatory protein, at least two of the non-affinity modified and/or affinity modified IgSF domains are identical IgSF domains.

In some embodiments, a stacked immunomodulatory protein provided herein comprises at least two affinity modified and/or non-affinity modified IgSF domains from a single IgSF member but in a non-wild-type arrangement (alternatively, "permutation"). One illustrative example of a non-wild type arrangement or permutation is an immunomodulatory protein comprising a non-wild-type order of affinity modified and/or non-affinity modified IgSF domain sequences relative to those found in the wild-type PD-L2 whose IgSF domain sequences served as the source of the variant IgSF domains as provided herein. Thus, in one example, the immunomodulatory protein can comprise an IgV proximal and an IgC distal to the transmembrane domain albeit in a non-affinity modified and/or affinity modified form. The presence, in an immunomodulatory protein provided herein, of both non-wild-type combinations and non-wild-type arrangements of non-affinity modified and/or affinity modified IgSF domain is also within the scope of the provided subject matter.

In some embodiments of a stacked immunomodulatory protein, the non-affinity modified and/or affinity modified IgSF domains are non-identical (i.e., different) IgSF domains. Non-identical affinity modified IgSF domains specifically bind, under specific binding conditions, different cognate binding partners and are "non-identical" irrespective of whether or not the wild-type or unmodified IgSF domains from which they are engineered was the same. Thus, for example, a non-wild-type combination of at least two non-identical IgSF domains in an immunomodulatory protein can comprise at least one IgSF domain sequence whose origin is from and unique to one PD-L2, and at least one of a second IgSF domain sequence whose origin is from and unique to another IgSF family member that is not PD-L2, wherein the IgSF domains of the immunomodulatory protein are in non-affinity modified and/or affinity modified form. However, in alternative embodiments, the two non-identical IgSF domains originate from the same IgSF domain sequence but at least one is affinity modified such that they specifically bind to different cognate binding partners.

A plurality of non-affinity modified and/or affinity modified IgSF domains in a stacked immunomodulatory protein polypeptide chain need not be covalently linked directly to one another. In some embodiments, an intervening span of one or more amino acid residues indirectly covalently bonds the non-affinity modified and/or affinity modified IgSF domains to each other. The linkage can be via the N-terminal to C-terminal residues.

In some embodiments, the two or more IgSF domain, including a vIgD of PD-L2 and one or more additional IgSF domain (e.g. second or third variant IgSF domain) from another IgSF family member, are covalently or non-covalently linked. In some embodiments, the two or more IgSF domains are linked directly or indirectly, such as via a linker. In some embodiments, an intervening span of one or more amino acid residues indirectly covalently bonds IgSF domains to each other. The linkage can be via the N-terminal to C-terminal residues. In some embodiments, the linkage can be made via side chains of amino acid residues that are not located at the N-terminus or C-terminus of the IgSF domain(s). Thus, linkages can be made via terminal or internal amino acid residues or combinations thereof.

Figure 5A:
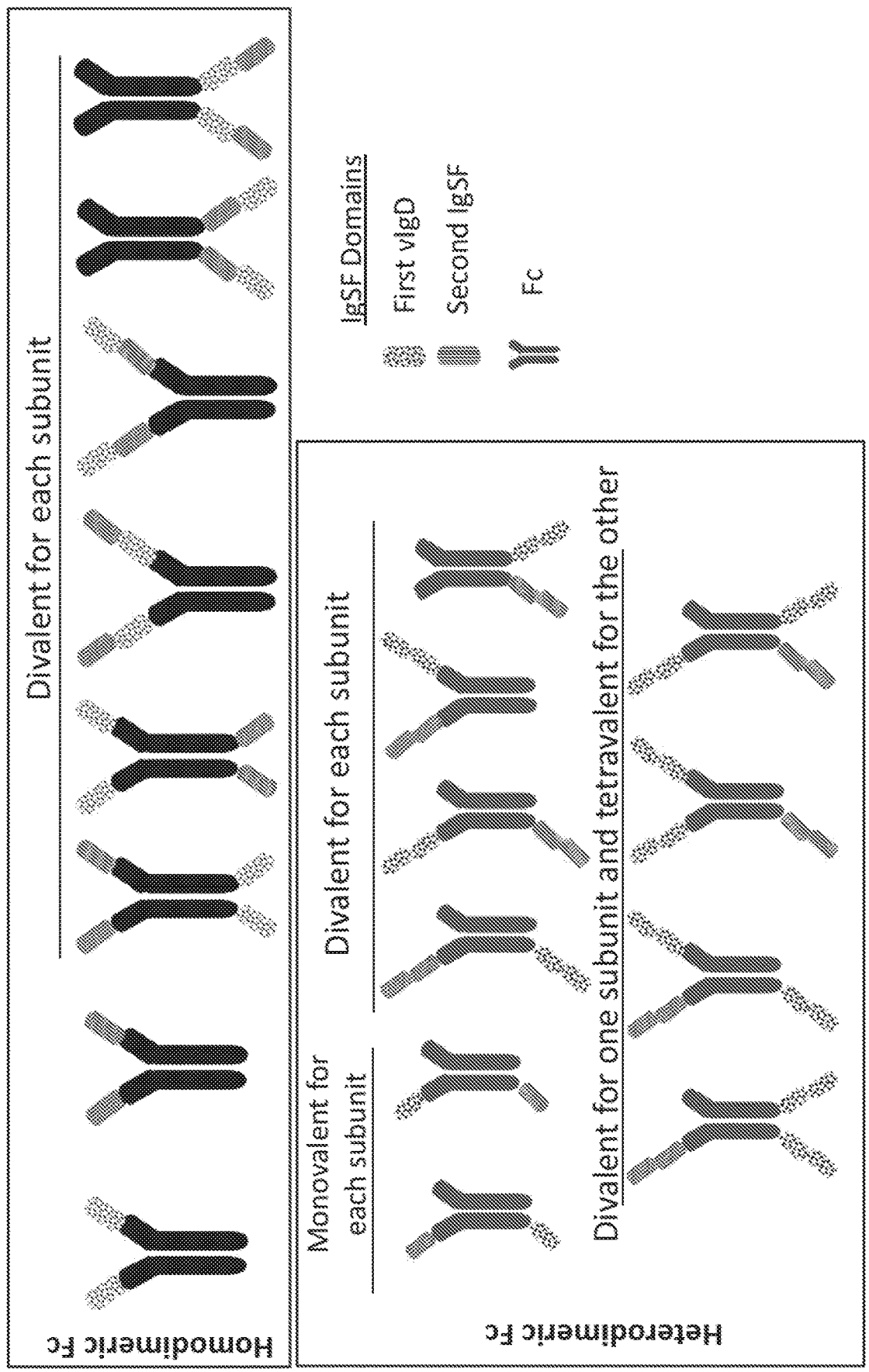
FIG. 5A depicts various exemplary configurations of a stack molecule containing a first variant IgSF domain (first vIgD) and a second IgSF domain, such as a second variant IgSF domain (second vIgD). As shown, the first vIgD and second IgSF domain are independently linked, directly or indirectly, to the N- or C-terminus of an Fc region. For generating a homodimeric Fc molecule, the Fc region is one that is capable of forming a homodimer with a matched Fc region by co-expression of the individual Fc regions in a cell. For generating a heterodimeric Fc molecule, the individual Fc regions contain mutations (e.g. "knob-into-hole" mutations in the CH3 domain), such that formation of the heterodimer is favored compared to homodimers when the individual Fc regions are co-expressed in a cell.
Figure 5B:
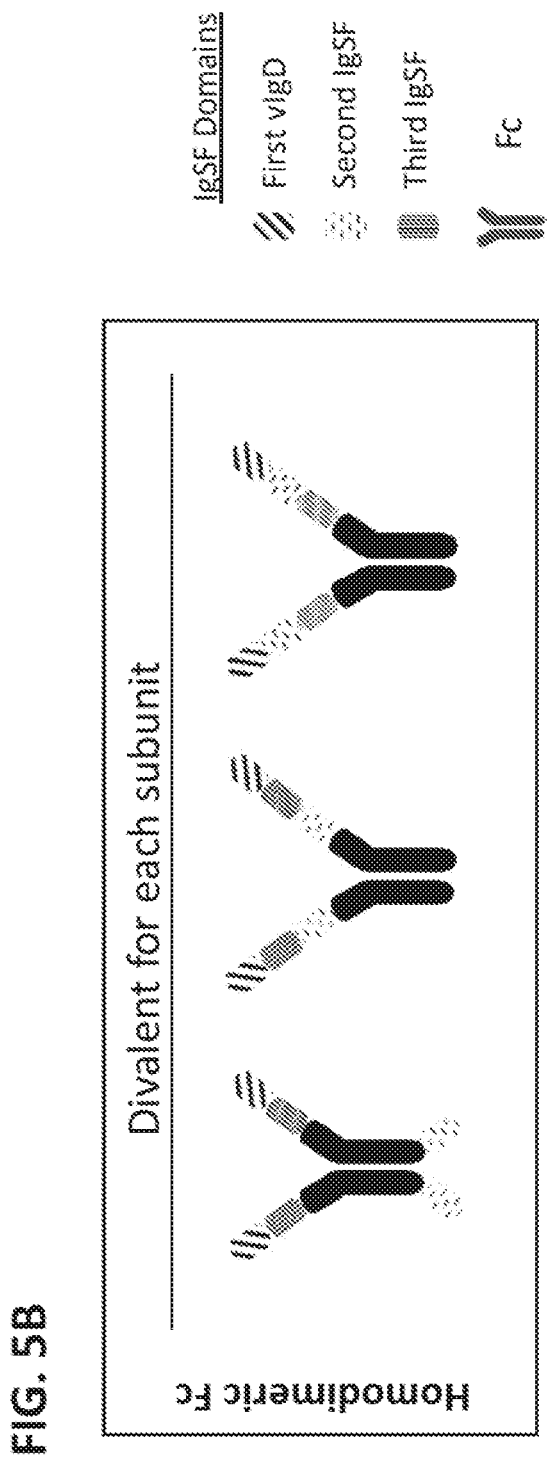
FIG. 5B depicts various exemplary configurations of a stack molecule containing a first variant IgSF domain (first vIgD), a second IgSF domain, such as a second variant IgSF domain (second vIgD), and a third IgSF domain, such as a third variant IgSF domain (third vIgD). As shown, the first vIgD, second IgSF, and third IgSF domains are independently linked, directly or indirectly, to the N- or C-terminus of an Fc region. For generating a homodimeric Fc molecule, the Fc region is one that is capable of forming a homodimer with a matched Fc region by co-expression of the individual Fc regions in a cell.
Figure 6:
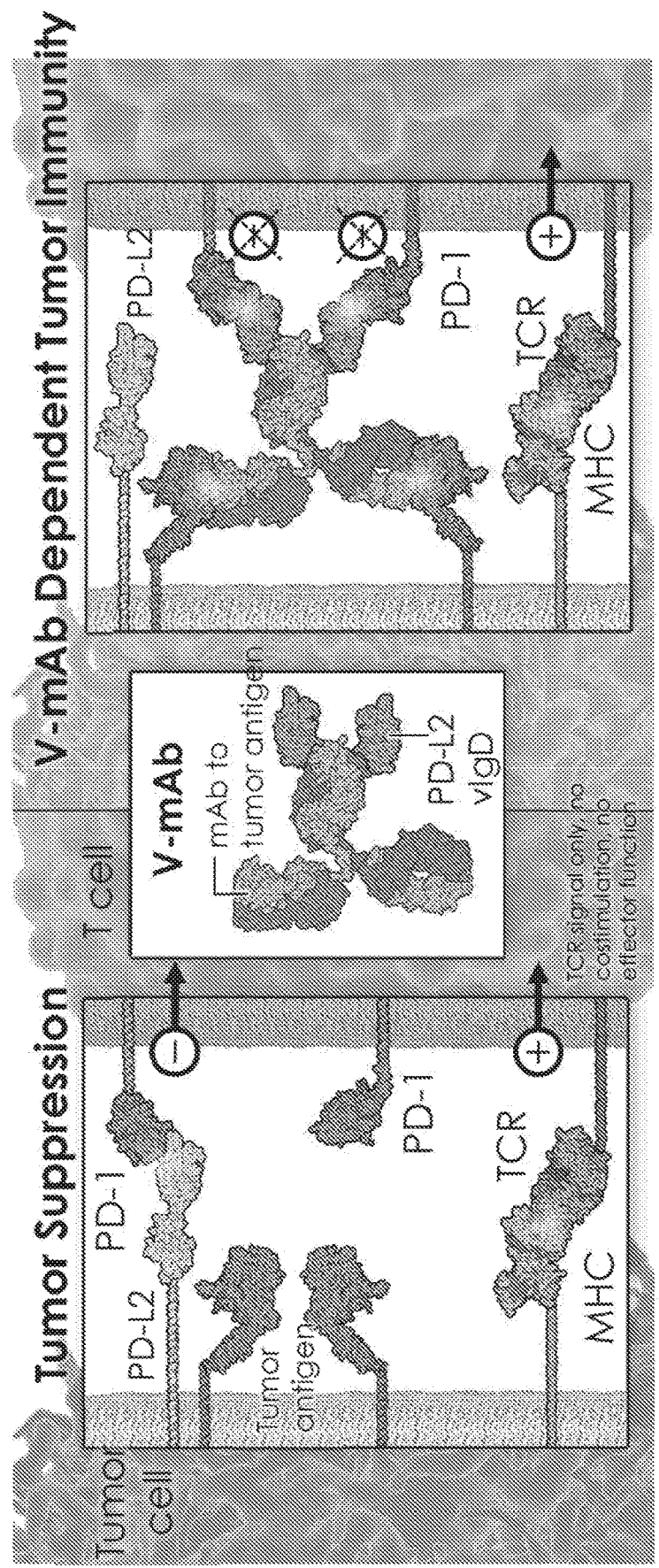
FIG. 6 depicts an exemplary schematic of the activity of a variant IgSF domain (vIgD)—conjugated to an antibody (V-Mab) in which the antibody (e.g. anti-HER2 antibody) binds to an antigen on the surface of the tumor cell to localize the vIgD to the cell. As shown, binding of the antibody to the surface of the tumor cell localizes the vIgD on the tumor cell surface where it can interact with one or more of its cognate binding partners expressed on the surface of an adjacent immune cell (e.g. T cell) to agonize or antagonize receptor signaling. In an exemplary embodiment as shown, the variant IgSF domain (vIgD) is a variant of an IgSF domain of PD-L2 that binds, such as has increased affinity for, the inhibitory receptor PD-1. Binding of the PD-L2 vIgD to the PD-1 inhibitory receptor antagonizes or blocks the negative signaling of the inhibitory receptor, thereby resulting in an activated T cell or effector T cell. In some cases, if clustering of the inhibitory receptor (PD-1) is proximal to an activating receptor (e.g. CD28) then agonizing of the inhibitory receptor activity by the TIP may be realized.

In some embodiments, the immunomodulatory protein contains at least two IgSF domains, each linked directly or indirectly via a linker. In some embodiments, the immunomodulatory protein contains at least three immunomodulatory proteins, each linked directly or indirectly via a linker. Various configurations are shown in FIGS. 5A and 5B.

In some embodiments, one or more "peptide linkers" link the vIgD of PD-L2 and one or more additional IgSF domain (e.g. second or third variant IgSF domain). In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is a flexible linker. In some embodiments, the linker is (in one-letter amino acid code): GGGGS ("4GS") or multimers of the 4GS linker, such as repeats of 2, 3, 4, or 5 4GS linkers. In some embodiments, the peptide linker is (GGGGS)$_2$(SEQ ID NO:264) or (GGGGS)$_3$(SEQ ID NO:263). In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 2030 (1×EAAAK), SEQ ID NO: 2031 (3×EAAAK) or SEQ ID NO: 2032 (5×EAAAK). In some embodiments, the linker can further include amino acids introduced by cloning and/or from a restriction site, for example the linker can include the amino acids GS (in one-letter amino acid code) as introduced by use of the restriction site BAMHI. For example, in some embodiments, the linker (in one-letter amino acid code) is GSGGGGS (SEQ ID NO:1741), GS(G$_4$S)$_3$ (SEQ ID NO: 2040), or GS(G$_4$S)$_5$ (SEQ ID NO: 2041). In some examples, the linker is a 2×GGGGS followed by three alanines (GGGGSGGGGSAAA; SEQ ID NO: 265). In some cases, various combinations of peptide linkers are used.

In some embodiments, the non-affinity modified and/or affinity modified IgSF domains are linked by "wild-type peptide linkers" inserted at the N-terminus and/or C-terminus of a non-affinity modified and/or affinity modified IgSF domains. These linkers are also called leading sequences (N-terminal to non-affinity modified or affinity modified IgSF domain) or trailing sequences (C-terminal to non-affinity modified or affinity modified IgSF domain), and sequences that exist in the wild-type protein that span immediately outside the structural prediction of the Ig fold of the IgSF. In some embodiments, the "wild-type linker" is an amino acid sequence that exists after the signal sequence, but before in the IgSF domain, such as the defined IgV domain, in the amino acid sequence of the wild-type protein. In some embodiments, the "wild-type" linker is an amino acid sequence that exists immediately after the IgSF domain, such as immediately after the defined IgV domain but before the IgC domain, in the amino acid sequence of the wild-type protein. These linker sequences can contribute to the proper folding and function of the neighboring IgSF domain(s). In some embodiments, there is present a leading peptide linker inserted at the N-terminus of the first IgSF domain and/or a trailing sequence inserted at the C-terminus of the first non-affinity modified and/or affinity modified IgSF domain. In some embodiments, there is present a second leading peptide linker inserted at the N-terminus of the second IgSF domain and/or a second trailing sequence inserted at the C-terminus of the second non-affinity modified and/or affinity modified IgSF domain. When the first and second non-affinity modified and/or affinity modified IgSF domains are derived from the same parental protein and are connected in the same orientation, wild-type peptide linkers between the first and second non-affinity modified and/or affinity modified IgSF domains are not duplicated. For example, when the first trailing wild-type peptide linker and the second leading wild-type peptide linker are the same, the Type II immunomodulatory protein does not comprise either the first trailing wild-type peptide linker or the second leading wild-type peptide linker.

In some embodiments, the Type II immunomodulatory protein comprises a first leading wild-type peptide linker inserted at the N-terminus of the first non-affinity modified and/or affinity modified IgSF domain, wherein the first leading wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately preceding domain (such as a signal peptide or an IgSF domain). In some embodiments, the first leading wild-type peptide linker comprises the entire intervening sequence in the wild-type protein from which the first non-affinity modified and/or affinity modified IgSF domain is derived between the parental IgSF domain and the immediately preceding domain (such as a signal peptide or an IgSF domain).

In some embodiments, the Type II immunomodulatory protein further comprises a first trailing wild-type peptide linker inserted at the C-terminus of the first non-affinity modified and/or affinity modified IgSF domain, wherein the first trailing wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately following domain (such as an IgSF domain or a transmembrane domain). In some embodiments, the first trailing wild-type peptide linker comprises the entire intervening sequence in the wild-type protein from which the first non-affinity modified and/or affinity modified IgSF domain is derived between the parental IgSF domain and the immediately following domain (such as an IgSF domain or a transmembrane domain).

In some embodiments, the Type II immunomodulatory protein further comprises a second leading wild-type peptide linker inserted at the N-terminus of the second non-affinity modified and/or affinity modified IgSF domain, wherein the second leading wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately preceding domain (such as a signal peptide or an IgSF domain). In some embodiments, the second leading wild-type peptide linker comprises the entire intervening sequence in the wild-type protein from which the second non-affinity modified and/or affinity modified IgSF domain is derived between the parental IgSF domain and the immediately preceding domain (such as a signal peptide or an IgSF domain).

In some embodiments, the Type II immunomodulatory protein further comprises a second trailing wild-type peptide linker inserted at the C-terminus of the second non-affinity modified and/or affinity modified IgSF domain, wherein the second trailing wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately following domain (such as an IgSF domain or a transmembrane domain). In some embodiments, the second trailing wild-type peptide linker comprises the entire intervening sequence in the wild-type protein from which the second non-affinity modified and/or affinity modified IgSF domain is derived between the parental IgSF domain and the immediately following domain (such as an IgSF domain or a transmembrane domain).

In some embodiments, the two or more IgSF domain, including a vIgD of PD-L2 and one or more additional IgSF domain (e.g. second and/or third variant IgSF domain) from another IgSF family member, are linked or attached to a multimerization domain, such as to an Fc to form an Fc fusion, which, upon expression in a cell can, in some aspects, produce a dimeric multi-domain stack immunomodulatory protein. Thus, also provided are dimeric multi-domain immunomodulatory proteins.

In some embodiments, the variant PD-L2 polypeptide and one or more additional IgSF domain are independently linked, directly or indirectly, to the N- or C-terminus of a multimerization domain, such as an Fc region. In some embodiments, the variant PD-L2 polypeptide and at least one of the one or more additional IgSF domain are linked, directly or indirectly, and one of the variant PD-L2 and one of the one or more additional IgSF domain is also linked, directly or indirectly, to the N- or C-terminus of the multimerization domain, such as an Fc region. In some embodiments, the N- or C-terminus of the multimerization domain, such as an Fc region, is linked to the variant PD-L2 polypeptide or the one or more additional IgSF domain and the other of the N- or C-terminus of the Fc region is linked to the other of the PD-L2 variant or another of the one or more additional IgSF domain. In some embodiments, linkage to the multimerization domain, such as to an Fc, is via a peptide linker, e.g. a peptide linker, such as described above. In some embodiments, linkage between the variant PD-L2 and the one or more additional second IgSF domain is via a peptide linker, e.g. a peptide linker, such as described above. In some embodiments, the vIgD of PD-L2, the one or more additional IgSF domains, and the multimerization domain, such as an Fc domain, can be linked together in any of numerous configurations as depicted in FIGS. 5A and 5B. Exemplary configurations are described in the Examples.

In some embodiments, the stacked immunomodulatory protein is a dimer formed by two immunomodulatory Fc fusion polypeptides. Also provided are nucleic acid molecules encoding any of the stacked immunomodulatory proteins. In some embodiments, the dimeric multi-domain stack immunomodulatory protein can be produced in cells by expression, or in some cases co-expression, of stack immunomodulatory Fc fusion polypeptides, such as described above in accord with generating dimeric Fc fusion proteins.

In some embodiments, the dimeric multi-domain stack immunomodulatory protein is divalent for each Fc region, monovalent for each subunit, or divalent for one subunit and tetravalent for the other.

In some embodiments, the dimeric multi-domain stack immunomodulatory protein is a homodimeric multi-domain stack Fc protein. In some embodiments, the dimeric multi-domain stack immunomodulatory protein comprises a first stack immunomodulatory Fc fusion polypeptide and a second stack immunomodulatory Fc fusion polypeptide in which the first and second polypeptide are the same. In some embodiments, the multi-domain stack molecule contains a first Fc fusion polypeptide containing a variant PD-L2 and a second IgSF domain and a second Fc fusion polypeptide containing the variant PD-L2 and the second IgSF domain. In some embodiments, the multi-domain stack molecule contains a first Fc fusion polypeptide containing a variant PD-L2, a second IgSF domain, and a third IgSF domain and a second Fc fusion polypeptide containing the variant PD-L2, the second IgSF domain, and the third IgSF domain. In some embodiments, the Fc portion of the first and/or second fusion polypeptide can be any Fc as described above. In some embodiments, the Fc portion or region of the first and second fusion polypeptide is the same.

In some embodiments, the multi-domain stack molecule is heterodimeric, comprising two different Fc fusion polypeptides, e.g. a first and a second Fc polypeptide, wherein at least one is an Fc polypeptide containing a is an Fc fusion polypeptide containing at least one variant PD-L2 polypeptide and/or at least one second IgSF domain (e.g. second variant IgSF domain). In some embodiments, the first or second Fc fusion polypeptide further contains a third IgSF domain (e.g. third variant IgSF domain). In some embodiments, the multi-domain stack molecule contains a first Fc fusion polypeptide containing a variant PD-L2 and a second Fc fusion polypeptide containing at a second IgSF domain, in which, in some cases, the first or second Fc fusion polypeptide additionally contains a third IgSF domain. In some embodiments, the multi-domain stack molecule contains a first Fc fusion polypeptide containing a variant PD-L2, a second IgSF domain, and in some cases, a third IgSF domain and a second Fc fusion polypeptide that is not linked to either a variant PD-L2 polypeptide or an additional IgSF domain. In some embodiments, the Fc portion or region of the first and second fusion polypeptide is the same. In some embodiments, the Fc portion or region of the first and second fusion polypeptide is different.

In some embodiments, the multi-domain stack molecule contains a first Fc fusion polypeptide containing 1, 2, 3, 4 or more variant PD-L2 polypeptides and 1, 2, 3, 4 or more additional IgSF domains, wherein the total number of IgSF domains in the first stack Fc fusion polypeptide is greater than 2, 3, 4, 5, 6 or more. In one example of such an embodiment, the second stack Fc polypeptide contains 1, 2, 3, 4 or more additional variant PD-L2 polypeptides and 1, 2, 3, 4 or more second IgSF domains, wherein the total number of IgSF domains in the second stack Fc fusion polypeptide is greater than 2, 3, 4, 5, 6 or more. In another example of such embodiments, the second Fc fusion polypeptide is not linked to either a variant PD-L2 polypeptide or additional IgSF domain.

In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc polypeptide fusion containing an Fc region and a first variant PD-L2 polypeptide and/or second IgSF domain (e.g. second variant IgSF domain) and a second Fc polypeptide fusion containing an Fc region and the other of the first variant PD-L2 polypeptide or the second IgSF domain. In some embodiments, a heterodimeric stack molecule contains a first Fc polypeptide fusion containing an Fc region and a first variant PD-L2 polypeptide and/or second IgSF domain (e.g. second variant IgSF domain) and a second Fc subunit containing both the first variant PD-L2 polypeptide and second IgSF domain (e.g. second variant IgSF domain) but in a different orientation or configuration from the first Fc region. In some embodiments, the first and/or second Fc fusion polypeptide also contains a third IgSF domain (e.g. third variant IgSF domain).

In some embodiments, the Fc domain of one or both of the first and second stacked immunomodulatory Fc fusion polypeptide comprises a modification (e.g. substitution) such that the interface of the Fc molecule is modified to facilitate and/or promote heterodimerization. In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a sequence of amino acids is added preceding the Fc sequence for constructs in which the Fc sequence was the N-terminal portion of the sequence. In some cases, the sequence of amino acids HMSSVSAQ (SEQ ID NO:1190) is added immediately preceding the Fc sequence for constructs in which the Fc sequence was the N-terminal portion of the sequence. In some embodiments, a heterodimeric stack molecule contains a first Fc polypeptide fusion containing an Fc region (knob) and a first variant polypeptide and/or second IgSF domain (e.g. second variant IgSF domain) and a second Fc polypeptide fusion containing an Fc region (hole) and a stuffer sequence HMSSVSAQ (SEQ ID NO:1190) was added immediately preceding both Fc regions of the first and second Fc polypeptide fusion.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tryptophan (W). In some examples, the original residue identified for replacement is an amino acid residue that has a small side chain such as, for example, alanine, asparagine, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 Å2 from each surface (see e.g., Deisenhofer et al. (1981) Biochemistry, 20:2361-2370; Miller et al., (1990) J Mol. Biol., 216, 965-973; Ridgway et al., (1996) Prot. Engin., 9: 617-621; U.S. Pat. No. 5,731, 168). Modifications of a CH3 domain to create protuberances or cavities are described, for example, in U.S. Pat. No. 5,731,168; International Patent Applications WO98/50431 and WO 2005/063816; and Ridgway et al., (1996) Prot. Engin., 9: 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant, A. M., et al., Nature Biotech. 16 (1998) 677-681) e.g. by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g. as described by EP 1 870 459 A1.

In some embodiments, the Fc regions of the heterodimeric molecule additionally can contain one or more other Fc mutation, such as any described above. In some embodiments, the heterodimer molecule contains an Fc region with a mutation that reduces effector function.

In some embodiments, an Fc variant containing CH3 protuberance (knob) or cavity (hole) modifications can be joined to a stacked immunomodulatory polypeptide anywhere, but typically via its N- or C-terminus, to the N- or C-terminus of a first and/or second stacked immunomodulatory polypeptide, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s).

There is provided herein a homodimeric multi-domain stack molecule produced from a stack immunomodulatory Fc fusion polypeptide containing an IgSF domain, e.g. IgV domain, of a variant CD155 polypeptide and a second IgSF domain, e.g. IgV, of a variant PD-L2 polypeptide. In some embodiments, the first and second immunomodulatory Fc fusion polypeptide of the multi-domain stack molecule has the sequence set forth in any of SEQ ID NOS: 1191, 1192, 1193, 1194, 1195, or 1196 or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1191, 1192, 1193, 1194, 1195, or 1196 and contains the one more amino acid modifications in the variant PD-L2 and/or CD155 IgSF domain. In some embodiments, the resulting multi-domain stack molecules bind to both TIGIT and PD-1. In some aspects, the binding to TIGIT is to the same or similar degree or, in some cases, is increased, compared to the binding to TIGIT of the corresponding IgSF domain of unmodified or wild-type CD155. In some aspects, the binding to PD-1 is to the same or similar degree or, in some cases, is increased, compared to the binding to PD-1 of the corresponding IgSF domain of unmodified or wild-type PD-L1. In some embodiments, the binding to TIGIT or PD-1 is at least 30%, 40%, 50%, 60%, 70%, 80%, 90%, or more of the binding to TIGIT or PD-1 of the non-stacked form of the variant CD155 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the resulting multi-domain stack molecule increases T cell immune responses compared to the non-stack variant PD-L2 IgSF-Fc and/or variant CD155-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

There is provided herein a heterodimeric multi-domain stack molecule produced from a stack immunomodulatory Fc fusion polypeptide containing an IgSF domain, e.g. IgV domain, of a variant CD155 polypeptide and a second IgSF domain, e.g. IgV, of a variant PD-L2 polypeptide. In some embodiments, one of the first and second immunomodulatory Fc fusion polypeptide of the multi-domain stack molecule comprises a knob molecule that has the sequence set forth in any of SEQ ID NOS: 1197, 1198, 1199, 1200, 1201, or 1203, or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1197, 1198, 1199, 1200, 1201, or 1203, and contains the one more amino acid modifications in the variant PD-L2 and/or CD155 IgSF domain. In some embodiments, the other of the first and second immunomodulatory Fc fusion polypeptide of the multi-domain stack molecule comprises a hole molecule that has the sequence set forth in any of SEQ ID NOS: 1188, 1202, or 1204, or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1188, 1202, or 1204, and contains the one more amino acid modifications in the variant PD-L2 and/or CD155 IgSF domain. In some embodiments, the resulting multi-domain stack molecules bind to both TIGIT and PD-1. In some embodiments, the knob and hole molecules are expressed in various combinations and are generated by co-expression of a first stacked immunomodulatory polypeptide linked to an Fc variant containing CH3 protuberance modification(s) with a second stacked immunomodulatory polypeptide linked to an Fc variant containing CH3 cavity modification(s). For example, the first and second immunomodulatory Fc fusion polypeptide of the multi-domain stack molecule comprises a knob and hole molecule that has the pair of sequences set forth in any of SEQ ID NOS:1197+1188, 1198+1188, 1199+1188, 1200+1188, 1201+1202, 1203+1204, 1199+1204, 1199+1202, 1200+1202, 1200+1204, or a sequence of amino acids that has at least 85%, 86%, 87%, 88%, 89%, 90%, 91%, 92%, 93%, 94%, 95%, 96%, 97%, 98%, 99% or more sequence identity to any of the pairs of SEQ ID NOS: 1197+1188, 1198+1188, 1199+1188, 1200+1188, 1201+1202, 1203+1204, 1199+1204, 1199+1202, 1200+1202, 1200+1204, and contains the one more amino acid modifications in the variant PD-L2 and/or CD155 IgSF domain. In some cases, the knob or hole molecule includes a N-terminal HMSSVSAQ set forth in SEQ ID NO:1190. In some aspects, the binding to TIGIT is to the same or similar degree or, in some cases, is increased, compared to the binding to TIGIT of the corresponding IgSF domain of unmodified or wild-type CD155. In some aspects, the binding to PD-1 is to the same or similar degree or, in some cases, is increased, compared to the binding to PD-1 of the corresponding IgSF domain of unmodified or wild-type PD-L2. In some embodiments, the binding to TIGIT or PD-1 is at least 30%, 40%, 50%, 60%, 70%, 80%, 90%, or more of the binding to TIGIT or PD-1 of the non-stacked form of the variant CD155 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the resulting multi-domain stack molecule increases T cell immune responses compared to the non-stack variant PD-L2 IgSF-Fc and/or variant CD155-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

C. Conjugates and Fusions of Variant Polypeptides and Immunomodulatory Proteins

In some embodiments, the variant polypeptides provided herein, which are immunomodulatory proteins comprising variants of an Ig domain of the IgSF family (vIgD), can be conjugated with or fused with a moiety, such as an effector moiety, such as another protein, directly or indirectly, to form a conjugate ("IgSF conjugate"). In some embodiments, the attachment can be covalent or non-covalent, e.g., via a biotin-streptavidin non-covalent interaction. In some embodiments, the moiety can be a targeting moiety, a small molecule drug (non-polypeptide drug of less than 500 daltons molar mass), a toxin, a cytostatic agent, a cytotoxic agent, an immunosuppressive agent, a radioactive agent suitable for diagnostic purposes, a radioactive metal ion for therapeutic purposes, a prodrug-activating enzyme, an agent that increases biological half-life, or a diagnostic or detectable agent.

In some embodiments the effector moiety is a therapeutic agent, such as a cancer therapeutic agent, which is either cytotoxic, cytostatic or otherwise provides some therapeutic benefit. In some embodiments, the effector moiety is a targeting moiety or agent, such as an agent that targets a cell surface antigen, e.g., an antigen on the surface of a tumor cell. In some embodiments, the effector moiety is a label, which can generate a detectable signal, either directly or indirectly. In some embodiments, the effector moiety is a toxin. In some embodiments, the effector moiety is a protein, peptide, nucleic acid, small molecule or nanoparticle.

In some embodiments, 1, 2, 3, 4, 5 or more effector moieties, which can be the same or different, are conjugated, linked or fused to the variant polypeptide or protein to form an IgSF conjugate. In some embodiments, such effector moieties can be attached to the variant polypeptide or immunomodulatory protein using various molecular biological or chemical conjugation and linkage methods known in the art and described below. In some embodiments, linkers such as peptide linkers, cleavable linkers, non-cleavable linkers or linkers that aid in the conjugation reaction, can be used to link or conjugate the effector moieties to the variant polypeptide or immunomodulatory protein.

In some embodiments, the IgSF conjugate comprises the following components: (protein or polypeptide), $(L)_q$ and (effector moiety)$_m$, wherein the protein or polypeptide is any of the described variant polypeptides or immunomodulatory proteins capable of binding one or more cognate counter structure ligands as described; L is a linker for linking the protein or polypeptide to the moiety; m is at least 1; q is 0 or more; and the resulting IgSF conjugate binds to the one or more counter structure ligands. In particular embodiments, m is 1 to 4 and q is 0 to 8.

In some embodiments, there is provided an IgSF conjugate comprising a variant polypeptide or immunomodulatory protein provided herein conjugated with a targeting agent that binds to a cell surface molecule, for example, for targeted delivery of the variant polypeptide or immunomodulatory protein to a specific cell. In some embodiments, the targeting agent is a molecule(s) that has the ability to localize and bind to a molecule present on a normal cell/tissue and/or tumor cell/tumor in a subject. In other words, IgSF conjugates comprising a targeting agent can bind to a ligand (directly or indirectly), which is present on a cell, such as a tumor cell. The targeting agents of the invention contemplated for use include antibodies, polypeptides, peptides, aptamers, other ligands, or any combination thereof, that can bind a component of a target cell or molecule.

In some embodiments, the targeting agent binds a tumor cell(s) or can bind in the vicinity of a tumor cell(s) (e.g., tumor vasculature or tumor microenvironment) following administration to the subject. The targeting agent may bind to a receptor or ligand on the surface of the cancer cell. In another aspect of the invention, a targeting agent is selected which is specific for a noncancerous cells or tissue. For example, a targeting agent can be specific for a molecule present normally on a particular cell or tissue. Furthermore, in some embodiments, the same molecule can be present on normal and cancer cells. Various cellular components and molecules are known. For example, if a targeting agent is specific for EGFR, the resulting IgSF conjugate can target cancer cells expressing EGFR as well as normal skin epidermal cells expressing EGFR. Therefore, in some embodiments, an IgSF conjugate of the invention can operate by two separate mechanisms (targeting cancer and non-cancer cells).

In various aspects of the invention disclosed herein an IgSF conjugate of the invention comprises a targeting agent which can bind/target a cellular component, such as a tumor antigen, a bacterial antigen, a viral antigen, a mycoplasm antigen, a fungal antigen, a prion antigen, an antigen from a parasite. In some aspects, a cellular component, antigen or molecule can each be used to mean, a desired target for a targeting agent. For example, in various embodiments, a targeting agent is specific for or binds to a component, which includes but is not limited to, epidermal growth factor receptor (EGFR, ErbB-1, HER1), ErbB-2 (HER2/neu), ErbB-3/HER3, ErbB-4/HER4, EGFR ligand family; insulin-like growth factor receptor (IGFR) family, IGF-binding proteins (IGFBPs), IGFR ligand family; platelet derived growth factor receptor (PDGFR) family, PDGFR ligand family; fibroblast growth factor receptor (FGFR) family, FGFR ligand family, vascular endothelial growth factor receptor (VEGFR) family, VEGF family; HGF receptor family; TRK receptor family; ephrin (EPH) receptor family; AXL receptor family; leukocyte tyrosine kinase (LTK) receptor family; TIE receptor family, angiopoietin 1,2; receptor tyrosine kinase-like orphan receptor (ROR) receptor family, e.g. ROR1; CD171 (L1CAM); B7-H6 (NCR3LG1); PD-L2, tumor glycosylation antigen, e.g. sTn or Tn, such as sTn Ag of MUC1; LHR (LHCGR); phosphatidylserine, discoidin domain receptor (DDR) family; RET receptor family; KLG receptor family; RYK receptor family; MuSK receptor family; Transforming growth factor-α (TGF-α) receptors, TGF-β; Cytokine receptors, Class I (hematopoietin family) and Class II (interferon/IL-10 family) receptors, tumor necrosis factor (TNF) receptor superfamily (TNFRSF), death receptor family; cancer-testis (CT) antigens, lineage-specific antigens, differentiation antigens, alpha-actinin-4, ARTC1, breakpoint cluster region-Abelson (Bcr-abl) fusion products, B-RAF, caspase-5 (CASP-5), caspase-8 (CASP-8), β-catenin (CTNNB1), cell division cycle 27 (CDC27), cyclin-dependent kinase 4 (CDK4), CDKN2A, COA-I, dek-can fusion protein, EFTUD-2, Elongation factor 2 (ELF2), Ets variant gene 6/acute myeloid leukemia 1 gene ETS (ETC6-AML1) fusion protein, fibronectin (FN), e.g. the extradomain A (EDA) of fibronectin, GPNMB, low density lipid receptor/GDP-L fucose: β-D-galactose 2-α-L-fucosyltransferase (LDLR/FUT) fusion protein, HLA-A2. arginine to isoleucine exchange at residue 170 of the α-helix of the α2-domain in the HLA-A2gene (HLA-A*201-R170I), HLA-Al 1, heat shock protein 70-2 mutated (HSP70-2M), K1AA0205, MART2, melanoma ubiquitous mutated 1, 2, 3 (MUM-I, 2, 3), prostatic acid phosphatase (PAP), neo-PAP, Myosin class I, NFYC, OGT, OS-9, pml-RARα fusion protein, PRDX5, PTPRK, K-ras (KRAS2), N-ras (NRAS), HRAS, RBAF600, SIRT2, SNRPD1, SYT-SSX1 or -SSX2 fusion protein, Triosephosphate Isomerase, BAGE, BAGK-1, BAGE-2,3,4,5, GAGE-1,2,3,4,5,6,7,8, GnT-V (aberrant N-acetyl glucosaminyl transferase V, MGAT5), HERV-K-MEL, KK-LC, KM-HN-I, LAGE, LAGE-I, CTL-recognized antigen on melanoma (CAMEL), MAGE-A1 (MAGE-I), MAGE-A2, MAGE-A3, MAGE-A4, MAGE-A5, MAGE-A6, MAGE-A8, MAGE-A9, MAGE-AlO, MAGE-AI1, MAGE-A12, MAGE-3, MAGE-B1, MAGE-B2, MAGE-B5, MAGE-B6, MAGE-C1, MAGE-C2, mucin 1 (MUC1), MART-1/Melan-A (MLANA), gplOO, gplOO/Pmell7 (SILV), tyrosinase (TYR), TRP-I, HAGE, NA-88, NY-ESO-I, NY-ESO-1/LAGE-2, SAGE, Spl7, SSX-1,2,3,4, TRP2-INT2, carcinoembryonic antigen (CEA), Kallikrein 4, mammaglobin-A, OA1, prostate specific antigen (PSA), TRP-1/gp75, TRP-2, adipophilin, interferon inducible protein absent in melanoma 2 (AIM-2), BING-4, CPSF, cyclin Dl, epithelial cell adhesion molecule (Ep-CAM), EphA3, fibroblast growth factor-5 (FGF-5), glycoprotein 250 (gp250), EGFR (ERBB1), HER-2/neu (ERBB2), interleukin 13 receptor α2 chain (IL13Rα2), IL-6 receptor, intestinal carboxyl esterase (iCE), alpha-feto protein (AFP), M-CSF, mdm-2, MUCl, p53 (TP53), PBF, PRAME, PSMA, RAGE-I, RNF43, RU2AS, SOXlO, STEAPl, survivin (BIRC5), human telomerase reverse transcriptase (hTERT), telomerase, Wilms' tumor gene (WT1), SYCP1, BRDT, SPANX, XAGE, ADAM2, PAGE-5, LIPl, CTAGE-I, CSAGE, MMAl, CAGE, BORIS, HOM-TES-85, AF15q14, HCA661, LDHC, MORC, SGY-I, SPOl 1, TPX1, NY-SAR-35, FTHL17, NXF2, TDRD1, TEX15, FATE, TPTE, immunoglobulin idiotypes, Bence-Jones protein, estrogen receptors (ER), androgen receptors (AR), CD40, CD30, CD20, CD 19, CD33, cancer antigen 72-4 (CA 72-4), cancer antigen 15-3 (CA 15-3), cancer antigen 27-29 (CA 27-29), cancer antigen 125 (CA 125), cancer antigen 19-9 (CA 19-9), β-human chorionic gonadotropin, β-2 microglobulin, squamous cell carcinoma antigen, neuron-specific enolase, heat shock protein gp96, GM2, sargramostim, CTLA-4, 707 alanine proline (707-AP), adenocarcinoma antigen recognized by T cells 4 (ART-4), carcinoembryogenic antigen peptide-1 (CAP-I), calcium-activated chloride channel-2 (CLCA2), cyclophilin B (Cyp-B), human signet ring tumor-2 (HST-2), Human papilloma virus (HPV) proteins (HPV-E6, HPV-E7, major or minor capsid antigens, others), Epstein-Barr virus (EBV) proteins (EBV latent membrane proteins—LMP1, LMP2; others), Hepatitis B or C virus proteins, and HIV proteins.

In some embodiments, an IgSF conjugate, through its targeting agent, will bind a cellular component of a tumor cell, tumor vasculature or tumor microenvironment, thereby promoting killing of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells). Moreover, in some instances one or more of the foregoing pathways may operate upon administration of one or more IgSF conjugates of the invention.

In some embodiments, an IgSF conjugate, through its targeting agent, will be localized to, such as bind to, a cellular component of a tumor cell, tumor vasculature or tumor microenvironment, thereby modulating cells of the immune response in the vicinity of the tumor. In some embodiments, the targeting agent facilitates delivery of the conjugated IgSF (e.g. vIgD) to the tumor target, such as to interact with its cognate binding partner to alter signaling of immune cells (e.g. NK cells, monocytes/macrophages, dendritic cells, T cells, B cells) bearing the cognate binding partner. In some embodiments, localized delivery mediates an antagonizing or blocking activity of the PD-1 inhibitory receptor. In some embodiments, localized delivery agonizes the PD-1 inhibitory receptor, which, in some cases, can occur where there is proximal clustering of an activating receptor.

In some embodiments, the targeting agent is an immunoglobulin. As used herein, the term "immunoglobulin" includes natural or artificial mono- or polyvalent antibodies including, but not limited to, polyclonal, monoclonal, multispecific, human, humanized or chimeric antibodies, single chain antibodies, Fab fragments, F(ab') fragments, fragments produced by a Fab expression library, single chain Fv (scFv); anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, e.g., molecules that contain an antigen binding site that immunospecifically binds an antigen. The immunoglobulin molecules of the invention can be of any type (e.g., IgG, IgE, IgM, IgD, IgA, and IgY), class (e.g., IgG1, IgG2, IgG3, IgG4, IgA1, and IgA2) or subclass of immunoglobulin molecule.

In some embodiments, an IgSF conjugate, through its antibody targeting moiety, will bind a cellular component of a tumor cell, tumor vasculature or tumor microenvironment, thereby promoting apoptosis of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells).

In some embodiments, an IgSF conjugate, through its antibody targeting moiety, will bind a cellular component of a tumor cell, tumor vasculature or tumor microenvironment, thereby modulating the immune response (e.g., by activation of co-stimulatory molecules or inhibition of negative regulatory molecules of immune cell activation). In some embodiments, such conjugates can recognize, bind, and/or modulate (e.g. inhibit or activate) immune cells (e.g. NK cells, monocytes/macrophages, dendritic cells, T cells, B cells).

Antibody targeting moieties of the invention include antibody fragments that include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CH1, CH2, and CH3 domains. Also included in the invention are Fc fragments, antigen-Fc fusion proteins, and Fc-targeting moiety conjugates or fusion products (Fc-peptide, Fc-aptamer). The antibody targeting moieties of the invention may be from any animal origin including birds and mammals. In one aspect, the antibody targeting moieties are human, murine (e.g., mouse and rat), donkey, sheep, rabbit, goat, guinea pig, camel, horse, or chicken. Further, such antibodies may be humanized versions of animal antibodies. The antibody targeting moieties of the invention may be monospecific, bispecific, trispecific, or of greater multispecificity.

In various embodiments, an antibody/targeting moiety recruits, binds, and/or activates immune cells (e.g. NK cells, monocytes/macrophages, dendritic cells) via interactions between Fc (in antibodies) and Fc receptors (on immune cells) and via the conjugated variant polypeptides or immunomodulatory proteins provided herein. In some embodiments, an antibody/targeting moiety recognizes or binds a tumor agent via and localizes to the tumor cell the conjugated variant polypeptides or immunomodulatory proteins provided herein to facilitate modulation of immune cells in the vicinity of the tumor.

Examples of antibodies which can be incorporated into IgSF conjugates include but are not limited to antibodies such as Cetuximab (IMC-C225; Erbitux®), Trastuzumab (Herceptin®), Rituximab (Rituxan®; MabThera®), Bevacizumab (Avastin®), Alemtuzumab (Campath®; Campath-1H®; Mabcampath®), Panitumumab (ABX-EGF; Vectibix®), Ranibizumab (Lucentis®), Ibritumomab, Ibritumomab tiuxetan, (Zevalin®), Tositumomab, Iodine I 131 Tositumomab (BEXXAR®), Catumaxomab (Removab®), Gemtuzumab, Gemtuzumab ozogamicine (Mylotarg®), Abatacept (CTLA4-Ig; Orencia®), Belatacept (L104EA29YIg; LEA29Y; LEA), Ipilimumab (MDX-010; MDX-101), Tremelimumab (ticilimumab; CP-675,206), PRS-010, PRS-050, Aflibercept (VEGF Trap, AVE005), Volociximab (M200), F200, MORAb-009, SS1P (CAT-5001), Cixutumumab (IMC-A12), Matuzumab (EMD72000), Nimotuzumab (h-R3), Zalutumumab (HuMax-EGFR), Necitumumab IMC-11F8, mAb806/ch806, Sym004, mAb-425, Panorex @ (17-1A) (murine monoclonal antibody); Panorex @ (17-1A) (chimeric murine monoclonal antibody); IDEC-Y2B8 (murine, anti-CD2O MAb); BEC2 (anti-idiotypic MAb, mimics the GD epitope) (with BCG); Oncolym (Lym-1 monoclonal antibody); SMART MI95 Ab, humanized 13' I LYM-I (Oncolym), Ovarex (B43.13, anti-idiotypic mouse MAb); MDX-210 (humanized anti-HER-2 bispecific antibody); 3622W94 MAb that binds to EGP40 (17-1A) pancarcinoma antigen on adenocarcinomas; Anti-VEGF, Zenapax (SMART Anti-Tac (IL-2 receptor); SMART MI95 Ab, humanized Ab, humanized); MDX-210 (humanized anti-HER-2 bispecific antibody); MDX-447 (humanized anti-EGF receptor bispecific antibody); NovoMAb-G2 (pancarcinoma specific Ab); TNT (chimeric MAb to histone antigens); TNT (chimeric MAb to histone antigens); Gliomab-H (Monoclon s-Humanized Abs); GNI-250 Mab; EMD-72000 (chimeric-EGF antagonist); LymphoCide (humanized LL2 antibody); and MDX-260 bispecific, targets GD-2, ANA Ab, SMART ID1O Ab, SMART ABL 364 Ab or ImmuRAIT-CEA. As illustrated by the forgoing list, it is conventional to make antibodies to a particular target epitope.

In some embodiments, the antibody targeting moiety is a full length antibody, or antigen-binding fragment thereof, containing an Fc domain. In some embodiments, the variant polypeptide or immunomodulatory protein is conjugated to the Fc portion of the antibody targeting moiety, such as by conjugation to the N-terminus of the Fc portion of the antibody.

Figure 7A:
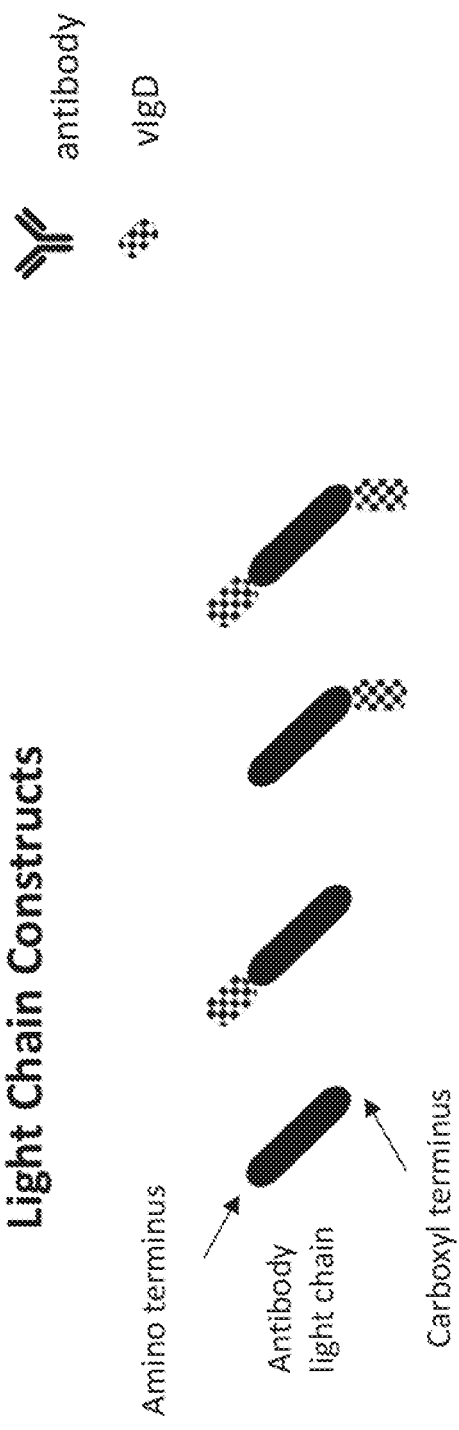
Figure 7B:
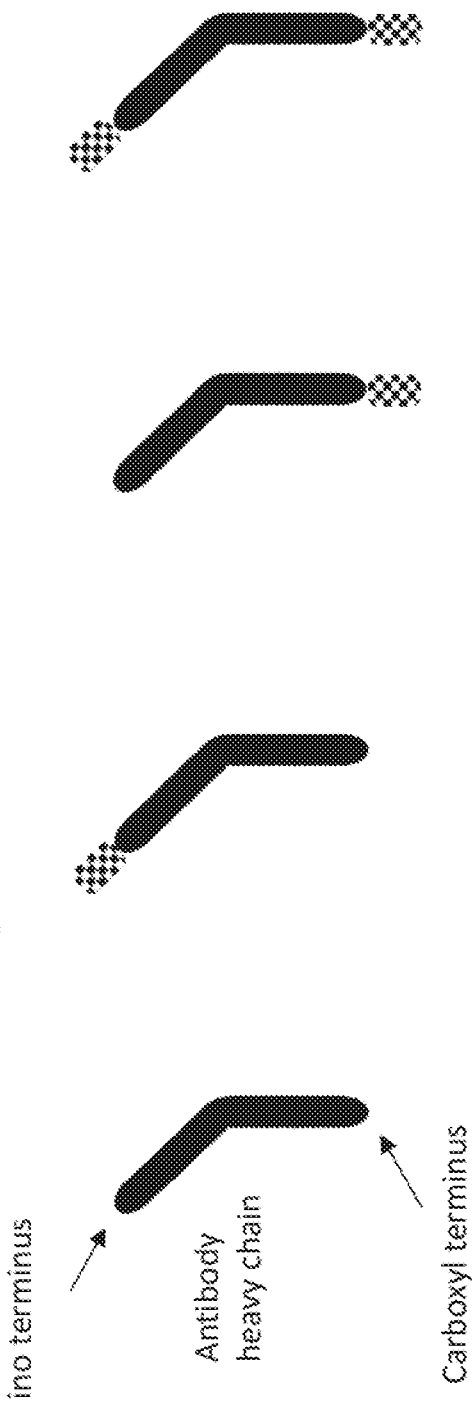

In some embodiments, the vIgD is linked, directly or indirectly, to the N- or C-terminus of the light and/or heavy chain of the antibody. In some embodiments, linkage can be via a peptide linker, such as any described above. Various configurations can be constructed. FIG. 7A-7C depict exemplary configurations. In some embodiments, the antibody conjugate can be produced by co-expression of the heavy and light chain of the antibody in a cell.

In one aspect of the invention, the targeting agent is an aptamer molecule. For example, in some embodiments, the aptamer is comprised of nucleic acids that function as a targeting agent. In various embodiments, an IgSF conjugate of the invention comprises an aptamer that is specific for a molecule on a tumor cell, tumor vasculature, and/or a tumor microenvironment. In some embodiments, the aptamer itself can comprise a biologically active sequence, in addition to the targeting module (sequence), wherein the biologically active sequence can induce an immune response to the target cell. In other words, such an aptamer molecule is a dual use agent. In some embodiments, an IgSF conjugate of the invention comprises conjugation of an aptamer to an antibody, wherein the aptamer and the antibody are specific for binding to separate molecules on a tumor cell, tumor vasculature, tumor microenvironment, and/or immune cells.

The term "aptamer" includes DNA, RNA or peptides that are selected based on specific binding properties to a particular molecule. For example, an aptamer(s) can be selected for binding a particular gene or gene product in a tumor cell, tumor vasculature, tumor microenvironment, and/or an immune cell, as disclosed herein, where selection is made by methods known in the art and familiar to one of skill in the art.

In some aspects of the invention the targeting agent is a peptide. For example, the variant polypeptides or immunomodulatory proteins provided herein can be conjugated to a peptide which can bind with a component of a cancer or tumor cells. Therefore, such IgSF conjugates of the invention comprise peptide targeting agents which binds to a cellular component of a tumor cell, tumor vasculature, and/or a component of a tumor microenvironment. In some embodiments, targeting agent peptides can be an antagonist or agonist of an integrin. Integrins, which comprise an alpha and a beta subunit, include numerous types well known to a skilled artisan.

In one embodiment, the targeting agent is Vvβ3. Integrin Vvβ3 is expressed on a variety of cells and has been shown to mediate several biologically relevant processes, including adhesion of osteoclasts to bone matrix, migration of vascular smooth muscle cells, and angiogenesis. Suitable targeting molecules for integrins include RGD peptides or peptidomimetics as well as non-RGD peptides or peptidomimetics (see, e.g., U.S. Pat. Nos. 5,767,071 and 5,780,426) for other integrins such as V4.βi (VLA-4), V4-P7 (see, e.g., U.S. Pat. No. 6,365,619; Chang et al, Bioorganic & Medicinal Chem Lett, 12:159-163 (2002); Lin et al., Bioorganic & Medicinal Chem Lett, 12:133-136 (2002)), and the like.

In some embodiments, there is provided an IgSF conjugate comprising a variant polypeptide or immunomodulatory protein provided herein conjugated with a therapeutic agent. In some embodiments, the therapeutic agent includes, for example, daunomycin, doxorubicin, methotrexate, and vindesine (Rowland et al., Cancer Immunol. Immunother. 21:183-187, 1986). In some embodiments, the therapeutic agent has an intracellular activity. In some embodiments, the IgSF conjugate is internalized and the therapeutic agent is a cytotoxin that blocks the protein synthesis of the cell, therein leading to cell death. In some embodiments, the therapeutic agent is a cytotoxin comprising a polypeptide having ribosome-inactivating activity including, for example, gelonin, bouganin, saporin, ricin, ricin A chain, bryodin, diphtheria toxin, restrictocin, Pseudomonas exotoxin A and variants thereof. In some embodiments, where the therapeutic agent is a cytotoxin comprising a polypeptide having a ribosome-inactivating activity, the IgSF conjugate must be internalized upon binding to the target cell in order for the protein to be cytotoxic to the cells.

In some embodiments, there is provided an IgSF conjugate comprising a variant polypeptide or immunomodulatory protein provided herein conjugated with a toxin. In some embodiments, the toxin includes, for example, bacterial toxins such as diphtheria toxin, plant toxins such as ricin, small molecule toxins such as geldanamycin (Mandler et al., J. Nat. Cancer Inst. 92(19):1573-1581 (2000); Mandler et al., Bioorganic & Med. Chem. Letters 10:1025-1028 (2000); Mandler et al., Bioconjugate Chem. 13:786-791 (2002)), maytansinoids (EP 1391213; Liu et al., Proc. Natl. Acad. Sci. USA 93:8618-8623 (1996)), and calicheamicin (Lode et al., Cancer Res. 58:2928 (1998); Hinman et al., Cancer Res. 53:3336-3342 (1993)). The toxins may exert their cytotoxic and cytostatic effects by mechanisms including tubulin binding, DNA binding, or topoisomerase inhibition.

In some embodiments, there is provided an IgSF conjugate comprising a variant polypeptide or immunomodulatory protein provided herein conjugated with a label, which can generate a detectable signal, indirectly or directly. These IgSF conjugates can be used for research or diagnostic applications, such as for the in vivo detection of cancer. The label is preferably capable of producing, either directly or indirectly, a detectable signal. For example, the label may be radio-opaque or a radioisotope, such as 3H, 14C, 32P, 35S, 123I, 125I, 131I; a fluorescent (fluorophore) or chemiluminescent (chromophore) compound, such as fluorescein isothiocyanate, rhodamine or luciferin; an enzyme, such as alkaline phosphatase, β-galactosidase or horseradish peroxidase; an imaging agent; or a metal ion. In some embodiments, the label is a radioactive atom for scintigraphic studies, for example 99Tc or 123I, or a spin label for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron. Zirconium-89 may be complexed to various metal chelating agents and conjugated to antibodies, e.g., for PET imaging (WO 2011/056983). In some embodiments, the IgSF conjugate is detectable indirectly. For example, a secondary antibody that is specific for the IgSF conjugate and contains a detectable label can be used to detect the IgSF conjugate.

The IgSF conjugates may be prepared using any methods known in the art. See, e.g., WO 2009/067800, WO 2011/133886, and U.S. Patent Application Publication No. 2014322129, incorporated by reference herein in their entirety.

The variant polypeptides or immunomodulatory proteins of an IgSF conjugate may be "attached to" the effector moiety by any means by which the variant polypeptides or immunomodulatory proteins can be associated with, or linked to, the effector moiety. For example, the variant polypeptides or immunomodulatory proteins of an IgSF conjugate may be attached to the effector moiety by chemical or recombinant means. Chemical means for preparing fusions or conjugates are known in the art and can be used to prepare the IgSF conjugate. The method used to conjugate the variant polypeptides or immunomodulatory proteins and effector moiety must be capable of joining the variant polypeptides or immunomodulatory proteins with the effector moiety without interfering with the ability of the variant polypeptides or immunomodulatory proteins to bind to their one or more counter structure ligands.

The variant polypeptides or immunomodulatory proteins of an IgSF conjugate may be linked indirectly to the effector moiety. For example, the variant polypeptides or immunomodulatory proteins of an IgSF conjugate may be directly linked to a liposome containing the effector moiety of one of several types. The effector moiety(s) and/or the variant polypeptides or immunomodulatory proteins may also be bound to a solid surface.

In some embodiments, the variant polypeptides or immunomodulatory proteins of an IgSF conjugate and the effector moiety are both proteins and can be conjugated using techniques well known in the art. There are several hundred crosslinkers available that can conjugate two proteins. (See for example "Chemistry of Protein Conjugation and Cross-linking," 1991, Shans Wong, CRC Press, Ann Arbor). The crosslinker is generally chosen based on the reactive functional groups available or inserted on the variant polypeptides or immunomodulatory proteins and/or effector moiety. In addition, if there are no reactive groups, a photoactivatible crosslinker can be used. In certain instances, it may be desirable to include a spacer between the variant polypeptides or immunomodulatory proteins and the effector moiety. Crosslinking agents known to the art include the homobifunctional agents: glutaraldehyde, dimethyladipimidate and Bi s(diazobenzidine) and the heterobifunctional agents: m Maleimidobenzoyl-N-Hydroxysuccinimide and Sulfo-m Maleimidobenzoyl-N-Hydroxysuccinimide.

In some embodiments, the variant polypeptides or immunomodulatory proteins of an IgSF conjugate may be engineered with specific residues for chemical attachment of the effector moiety. Specific residues used for chemical attachment of molecule known to the art include lysine and cysteine. The crosslinker is chosen based on the reactive functional groups inserted on the variant polypeptides or immunomodulatory proteins, and available on the effector moiety.

An IgSF conjugate may also be prepared using recombinant DNA techniques. In such a case a DNA sequence encoding the variant polypeptides or immunomodulatory proteins is fused to a DNA sequence encoding the effector moiety, resulting in a chimeric DNA molecule. The chimeric DNA sequence is transfected into a host cell that expresses the fusion protein. The fusion protein can be recovered from the cell culture and purified using techniques known in the art.

Examples of attaching an effector moiety, which is a label, to the variant polypeptides or immunomodulatory proteins include the methods described in Hunter, et al., Nature 144:945 (1962); David, et al., Biochemistry 13:1014 (1974); Pain, et al., J. Immunol. Meth. 40:219 (1981); Nygren, J. Histochem. and Cytochem. 30:407 (1982); Wensel and Meares, Radioimmunoimaging And Radioimmunotherapy, Elsevier, N.Y. (1983); and Colcher et al., "Use Of Monoclonal Antibodies As Radiopharmaceuticals For The Localization Of Human Carcinoma Xenografts In Athymic Mice", Meth. Enzymol., 121:802-16 (1986).

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as 99Tc or 123I, 186Re, 188Re and 111In can be attached via a cysteine residue in the peptide. Yttrium-90 can be attached via a lysine residue. The IODOGEN method (Fraker et al., Biochem. Biophys. Res. Commun. 80:49-57 (1978)) can be used to incorporate iodine-123. "Monoclonal Antibodies in Immunoscintigraphy" (Chatal, CRC Press 1989) describes other methods in detail.

Conjugates of the variant polypeptides or immunomodulatory proteins and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-p-isothiocyanatobenzyl-3-methyldiethylenetriaminepentaacetic acid (MX-DTPA) is an exemplary chelating agent for conjugation of radionucleotide to the antibody. See, e.g., WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., Cancer Research 52:127-131 (1992); U.S. Pat. No. 5,208,020) may be used.

The IgSF conjugates of the invention expressly contemplate, but are not limited to, drug conjugates prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A). See pages 467-498, 2003-2004 Applications Handbook and Catalog.

D. Transmembrane and Secretable Immunomodulatory Proteins and Engineered Cells

Provided herein are engineered cells which express the immunomodulatory variant PD-L2 polypeptides (alternatively, "engineered cells"). In some embodiments, the expressed immunomodulatory variant PD-L2 polypeptide is a transmembrane protein and is surface expressed. In some embodiments, the immunomodulatory variant PD-L2 polypeptide is expressed and secreted from the cell.

1. Transmembrane Immunomodulatory Proteins

In some embodiments, an immunomodulatory polypeptide comprising a variant PD-L2 can be a membrane bound protein. As described in more detail below, the immunomodulatory polypeptide can be a transmembrane immunomodulatory polypeptide comprising a variant PD-L2 in which is contained: an ectodomain containing at least one affinity modified IgSF domain (IgV or IgC), a transmembrane domain and, optionally, a cytoplasmic domain. In some embodiments, the transmembrane immunomodulatory protein can be expressed on the surface of an immune cell, such as a mammalian cell, including on the surface of a lymphocyte (e.g. T cell or NK cell) or antigen presenting cell. In some embodiments, the transmembrane immunomodulatory protein is expressed on the surface of a mammalian T-cell, including such T-cells as: a T helper cell, a cytotoxic T-cell (alternatively, cytotoxic T lymphocyte or CTL), a natural killer T-cell, a regulatory T-cell, a memory T-cell, or a gamma delta T-cell. In some embodiments, the mammalian cell is an antigen presenting cell (APC). Typically, but not exclusively, the ectodomain (alternatively, "extracellular domain") of comprises the one or more amino acid variations (e.g. amino acid substitutions) of the variant PD-L2 of the invention. Thus, for example, in some embodiments a transmembrane protein will comprise an ectodomain that comprises one or more amino acid substitutions of a variant PD-L2 of the invention.

In some embodiments, the engineered cells express a variant PD-L2 polypeptides are transmembrane immunomodulatory polypeptides (TIPs) that can be a membrane protein such as a transmembrane protein. In typical embodiments, the ectodomain of a membrane protein comprises an extracellular domain or IgSF domain thereof of a variant PD-L2 provided herein in which is contained one or more amino acid substitutions in at least one IgSF domain as described. The transmembrane immunomodulatory proteins provided herein further contain a transmembrane domain linked to the ectodomain. In some embodiments, the transmembrane domain results in an encoded protein for cell surface expression on a cell. In some embodiments, the transmembrane domain is linked directly to the ectodomain. In some embodiments, the transmembrane domain is linked indirectly to the ectodomain via one or more linkers or spacers. In some embodiments, the transmembrane domain contains predominantly hydrophobic amino acid residues, such as leucine and valine.

In some embodiments, a full length transmembrane anchor domain can be used to ensure that the TIPs will be expressed on the surface of the engineered cell, such as engineered T cell. Conveniently, this could be from a particular native protein that is being affinity modified (e.g. PD-L2 or other native IgSF protein), and simply fused to the sequence of the first membrane proximal domain in a similar fashion as the native IgSF protein (e.g. PD-L2). In some embodiments, the transmembrane immunomodulatory protein comprises a transmembrane domain of the corresponding wild-type or unmodified IgSF member, such as a transmembrane domain contained in the sequence of amino acids set forth in SEQ ID NO:4 (Table 2). In some embodiments, the membrane bound form comprises a transmembrane domain of the corresponding wild-type or unmodified polypeptide, such as corresponding to residues 221-241 of SEQ ID NO:4.

In some embodiments, the transmembrane domain is a non-native transmembrane domain that is not the transmembrane domain of native PD-L2. In some embodiments, the transmembrane domain is derived from a transmembrane domain from another non-PD-L2 family member polypeptide that is a membrane-bound or is a transmembrane protein. In some embodiments, a transmembrane anchor domain from another protein on T cells can be used. In some embodiments, the transmembrane domain is derived from CD8. In some embodiments, the transmembrane domain can further contain an extracellular portion of CD8 that serves as a spacer domain. An exemplary CD8 derived transmembrane domain is set forth in SEQ ID NO: 266 or 1212 or a portion thereof containing the CD8 transmembrane domain. In some embodiments, the transmembrane domain is a synthetic transmembrane domain.

In some embodiments, the transmembrane immunomodulatory protein further contains an endodomain, such as a cytoplasmic signaling domain, linked to the transmembrane domain. In some embodiments, the cytoplasmic signaling domain induces cell signaling. In some embodiments, the endodomain of the transmembrane immunomodulatory protein comprises the cytoplasmic domain of the corresponding wild-type or unmodified polypeptide, such as a cytoplasmic domain contained in the sequence of amino acids set forth in SEQ ID NO:4 (see Table 2).

In some embodiments, a provided transmembrane immunomodulatory protein that is or comprises a variant PD-L2 comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 216 and contains an ectodomain comprising at least one affinity-modified PD-L2 IgSF domain as described and a transmembrane domain. In some embodiments, the transmembrane immunomodulatory protein contains any one or more amino acid substitutions in an IgSF domain (e.g. IgV domain) as described, including any set forth in Table 1. In some embodiments, the transmembrane immunomodulatory protein can further comprise a cytoplasmic domain as described. In some embodiments, the transmembrane immunomodulatory protein can further contain a signal peptide. In some embodiments, the signal peptide is the native signal peptide of wild-type IgSF member, such as contained in the sequence of amino acids set forth in SEQ ID NO:4 (see e.g. Table 2).

Also provided is a nucleic acid molecule encoding such transmembrane immunomodulatory proteins. In some embodiments, a nucleic acid molecule encoding a transmembrane immunomodulatory protein comprises a nucleotide sequence that encodes a sequence of amino acids that exhibits at least 85%, 86%, 87%, 88%, 89%, 90%, 91%, 92%, 93%, 94%, 95%, 96%, 97%, 98% or 99% sequence identity to SEQ ID NOS: 216 and contains an ectodomain comprising at least one affinity-modified IgSF domain as described, a transmembrane domain and, optionally, a cytoplasmic domain. In some embodiments, the nucleic acid molecule can further comprise a sequence of nucleotides encoding a signal peptide. In some embodiments, the signal peptide is the native signal peptide of the corresponding wild-type IgSF member (see e.g. Table 2).

In some embodiments, provided are CAR-related transmembrane immunomodulatory proteins in which the endodomain of a transmembrane immunomodulatory protein comprises a cytoplasmic signaling domain that comprises at least one ITAM (immunoreceptor tyrosine-based activation motif)-containing signaling domain. ITAM is a conserved motif found in a number of protein signaling domains involved in signal transduction of immune cells, including in the CD3-zeta chain ("CD3-z") involved in T-cell receptor signal transduction. In some embodiments, the endodomain comprises at CD3-zeta signaling domain. In some embodiments, the CD3-zeta signaling domain comprises the sequence of amino acids set forth in SEQ ID NO: 243 or a sequence of amino acids that exhibits at least 85%, 86%, 87%, 88%, 89%, 90%, 91%, 92%, 93%, 94%, 95%, 96%, 97%, 98% or 99% to SEQ ID NO:243 and retains the activity of T cell signaling. In some embodiments, the endodomain of a CAR-related transmembrane immunomodulatory protein can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOS: 1213-1216 or a sequence of amino acids that exhibits at least 85%, 86%, 8'7%, 88%, 89%, 90%, 91%, 92%, 93%, 94%, 95%, 96%, 97%, 98% or 99% to SEQ ID NO:1213-1216 and retains the activity of T cell costimulatory signaling. In some embodiments, the provided CAR-related transmembrane immunomodulatory proteins have features of CARs to stimulate T cell signaling upon binding of an affinity modified IgSF domain to a cognate binding partner or counter structure. In some embodiments, upon specific binding by the affinity-modified IgSF domain to its counter structure can lead to changes in the immunological activity of the T-cell activity as reflected by changes in cytotoxicity, proliferation or cytokine production.

In some embodiments, the transmembrane immunomodulatory protein does not contain an endodomain capable of mediating cytoplasmic signaling. In some embodiments, the transmembrane immunomodulatory protein lacks the signal transduction mechanism of the wild-type or unmodified polypeptide and therefore does not itself induce cell signaling. In some embodiments, the transmembrane immunomodulatory protein lacks an intracellular (cytoplasmic) domain or a portion of the intracellular domain of the corresponding wild-type or unmodified polypeptide, such as a cytoplasmic signaling domain contained in the sequence of amino acids set forth in SEQ ID NO:4 (see Table 2). In some embodiments, the transmembrane immunomodulatory protein does not contain an ITIM (immunoreceptor tyrosine-based inhibition motif), such as contained in certain inhibitory receptors, including inhibitory receptors of the IgSF family (e.g. PD-1 or TIGIT). Thus, in some embodiments, the transmembrane immunomodulatory protein only contains the ectodomain and the transmembrane domain, such as any as described.

2. Secreted Immunomodulatory Proteins and Engineered Cells

In some embodiments, the PD-L2 variant immunomodulatory polypeptide containing any one or more of the amino acid mutations as described herein, is secretable, such as when expressed from a cell. Such a variant PD-L2 immunomodulatory protein does not comprise a transmembrane domain. In some embodiments, the variant PD-L2 immunomodulatory protein is not conjugated to a half-life extending moiety (such as an Fc domain or a multimerization domain). In some embodiments, the variant PD-L2 immunomodulatory protein comprises a signal peptide, e.g. an antibody signal peptide or other efficient signal sequence to get domains outside of cell. When the immunomodulatory protein comprises a signal peptide and is expressed by an engineered cell, the signal peptide causes the immunomodulatory protein to be secreted by the engineered cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided variant PD-L2 immunomodulatory proteins that further comprises a signal peptide. In some embodiments, provided herein is a nucleic acid molecule encoding the variant PD-L2 immunomodulatory protein operably connected to a secretion sequence encoding the signal peptide.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from the corresponding wild-type PD-L2 (see Table 2). In some embodiments, the signal peptide is a non-native signal peptide. For example, in some embodiments, the non-native signal peptide is a mutant native signal peptide from the corresponding wild-type PD-L2, and can include one or more (such as 2, 3, 4, 5, 6, 7, 8, 9, or 10 or more) substitutions insertions or deletions. In some embodiments, the non-native signal peptide is a signal peptide or mutant thereof of a family member from the same IgSF family as the wild-type IgSF family member. In some embodiments, the non-native signal peptide is a signal peptide or mutant thereof from an IgSF family member from a different IgSF family that the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g. HSA or albumin), a human azurocidin preprotein signal sequence, a luciferase, a trypsinogen (e.g. chymotrypsinogen or trypsinogen) or other signal peptide able to efficiently secrete a protein from a cell. Exemplary signal peptides include any described in the Table 9.

TABLE 9

Exemplary Signal Peptides

| SEQ ID NO | Signal Peptide | Peptide Sequence |
|---|---|---|
| SEQ ID NO: 245 | HSA signal peptide | MKWVTFISLLFLFSSAYS |
| SEQ ID NO: 246 | Ig kappa light chain | MDMRAPAGIFGFLLVLFPGYRS |
| SEQ ID NO: 247 | human azurocidin preprotein signal sequence | MTRLTVLALLAGLLASSRA |
| SEQ ID NO: 248 | IgG heavy chain signal peptide | MELGLSWIFLLAILKGVQC |
| SEQ ID NO: 249 | IgG heavy chain signal peptide | MELGLRWVFLVAILEGVQC |
| SEQ ID NO: 250 | IgG heavy chain signal peptide | MKHLWFFLLLVAAPRWVLS |
| SEQ ID NO: 251 | IgG heavy chain signal peptide | MDWTWRILFLVAAATGAHS |
| SEQ ID NO: 252 | IgG heavy chain signal peptide | MDWTWRFLFVVAAATGVQS |
| SEQ ID NO: 253 | IgG heavy chain signal peptide | MEFGLSWLFLVAILKGVQC |

TABLE 9-continued

Exemplary Signal Peptides

| SEQ ID NO | Signal Peptide | Peptide Sequence |
| --- | --- | --- |
| SEQ ID NO: 254 | IgG heavy chain signal peptide | MEFGLSWVFLVALFRGVQC |
| SEQ ID NO: 255 | IgG heavy chain signal peptide | MDLLHKNMKHLWFFLLLVAAPRWVLS |
| SEQ ID NO: 256 | IgG Kappa light chain signal sequences: | MDMRVPAQLLGLLLLWLSGARC |
| SEQ ID NO: 257 | IgG Kappa light chain signal sequences: | MKYLLPTAAAGLLLLAAQPAMA |
| SEQ ID NO: 258 | Gaussia luciferase | MGVKVLFALICIAVAEA |
| SEQ ED NO: 259 | Human albumin | MKWVTFISLLFLFSSAYS |
| SEQ ED NO: 260 | Human chymotlypsinogen | MAFLWLLSCWALLGTTFG |
| SEQ ED NO: 261 | Human interleukin-2 | MQLLSCIALILALV |
| SEQ ED NO: 262 | Human trypsinogen-2 | MNLLLILTFVAAAVA |

In some embodiments of a secretable variant PD-L2 immunomodulatory protein, the immunomodulatory protein comprises a signal peptide when expressed, and the signal peptide (or a portion thereof) is cleaved from the immunomodulatory protein upon secretion.

In some embodiments, the engineered cells express a variant PD-L2 polypeptides that are secreted from the cell. In some embodiments, such a variant PD-L2 polypeptide is encoded by a nucleic acid molecule encoding an immunomodulatory protein under the operable control of a signal sequence for secretion. In some embodiments, the encoded immunomodulatory protein is secreted when expressed from a cell. In some embodiments, the immunomodulatory protein encoded by the nucleic acid molecule does not comprise a transmembrane domain. In some embodiments, the immunomodulatory protein encoded by the nucleic acid molecule does not comprise a half-life extending moiety (such as an Fc domain or a multimerization domain). In some embodiments, the immunomodulatory protein encoded by the nucleic acid molecule comprises a signal peptide. In some embodiments, a nucleic acid of the invention further comprises nucleotide sequence that encodes a secretory or signal peptide operably linked to the nucleic acid encoding the immunomodulatory protein, thereby allowing for secretion of the immunomodulatory protein 3. Cells and Engineering Cells Provided herein are engineered cells expressing any of the provided immunomodulatory polypeptides. In some embodiments, the engineered cells express on their surface any of the provided transmembrane immunomodulatory polypeptides. In some embodiments, the engineered cells express and are capable of or are able to secrete the immunomodulatory protein from the cells under conditions suitable for secretion of the protein. In some embodiments, the immunomodulatory protein is expressed on or in a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, T helper cell, cytotoxic T-cell (alternatively, cytotoxic T lymphocyte or CTL), natural killer T-cell, regulatory T-cell, memory T-cell, or gamma delta T-cell. In some embodiments, the engineered T cells are CD4+ or CD8+.

In some embodiments, the engineered APCs include, for example, MHC II expressing APCs such as macrophages, B cells, and dendritic cells, as well as artificial APCs (aAPCs) including both cellular and acellular (e.g., biodegradable polymeric microparticles) aAPCs. Artificial APCs (aAPCs) are synthetic versions of APCs that can act in a similar manner to APCs in that they present antigens to T-cells as well as activate them. Antigen presentation is performed by the MHC (Class I or Class II). In some embodiments, in engineered APCs such as aAPCs, the antigen that is loaded onto the MHC is, in some embodiments, a tumor specific antigen or a tumor associated antigen. The antigen loaded onto the MHC is recognized by a T-cell receptor (TCR) of a T cell, which, in some cases, can express PD-1 or other molecule recognized by the variant PD-L2 polypeptides provided herein. Materials which can be used to engineer an aAPC include: poly (glycolic acid), poly(lactic-co-glycolic acid), iron-oxide, liposomes, lipid bilayers, sepharose, and polystyrene.

In some embodiments a cellular aAPC can be engineered to contain a TIP and TCR agonist which is used in adoptive cellular therapy. In some embodiments, a cellular aAPC can be engineered to contain a TIP and TCR agonist which is used in ex vivo expansion of human T cells, such as prior to administration, e.g. for reintroduction into the patient. In some aspects, the aAPC may include expression of at least one anti-CD3 antibody clone, e.g. such as, for example, OKT3 and/or UCHT1. In some aspects, the aAPCs may be inactivated (e.g. irradiated). In some embodiment, the TIP can include any variant IgSF domain that exhibits binding affinity for a cognate binding partner on a T cell.

In some embodiments, an immunomodulatory protein provided herein, such as a transmembrane immunomodulatory protein or a secretable immunomodulatory protein, is co-expressed or engineered into a cell that expresses an antigen-binding receptor, such as a recombinant receptor, such as a chimeric antigen receptor (CAR) or T cell receptor (TCR). In some embodiments, the engineered cell, such as an engineered T cell, recognizes a desired antigen associated with cancer, inflammatory and autoimmune disorders, or a viral infection. In specific embodiments, the antigen-binding receptor contains an antigen-binding moiety that specifically binds a tumor specific antigen or a tumor associated antigen. In some embodiments, the engineered T-cell is a CAR (chimeric antigen receptor) T-cell that contains an antigen-binding domain (e.g. scFv) that specifically binds to an antigen, such as a tumor specific antigen or tumor associated antigen. In some embodiments, the TIP protein is expressed in an engineered T-cell receptor cell or an engineered chimeric antigen receptor cell. In such embodiments, the engineered cell co-expresses the TIP and the CAR or TCR. In some embodiments, the SIP protein is expressed in an engineered T-cell receptor cell or an engineered chimeric antigen receptor cell. In such embodiments, the engineered cell co-expresses the SIP and the CAR or TCR.

In some embodiments, the SIP protein is expressed in an engineered T-cell receptor cell or an engineered chimeric antigen receptor cell. In such embodiments, the engineered cell co-expresses the SIP and the CAR or TCR.

Chimeric antigen receptors (CARs) are recombinant receptors that include an antigen-binding domain (ectodomain), a transmembrane domain and an intracellular signaling region (endodomain) that is capable of inducing or mediating an activation signal to the T cell after the antigen is bound. In some example, CAR-expressing cells are engineered to express an extracellular single chain variable fragment (scFv) with specificity for a particular tumor antigen linked to an intracellular signaling part comprising an activating domain and, in some cases, a costimulatory domain. The costimulatory domain can be derived from, e.g., CD28, OX-40, 4-1BB/CD137, inducible T cell costimulator (ICOS), The activating domain can be derived from, e.g., CD3, such as CD3 zeta, epsilon, delta, gamma, or the like. In certain embodiments, the CAR is designed to have two, three, four, or more costimulatory domains. The CAR scFv can be designed to target an antigen exressed on a cell associated with a disease or condition, e.g. a tumor antigen, such as, for example, CD19, which is a transmembrane protein expressed by cells in the B cell lineage, including all normal B cells and B cell malignances, including but not limited to NHL, CLL, and non-T cell ALL. Example CAR+ T cell therapies and constructs are described in U.S. Patent Publication Nos. 2013/0287748, 2014/0227237, 2014/0099309, and 2014/0050708, and these references are incorporated by reference in their entirety.

In some aspects, the antigen-binding domain is an antibody or antigen-binding fragment thereof, such as a single chain fragment (scFv). In some embodiments, the antigen is expressed on a tumor or cancer cell. Exemplary of an antigen is CD19. Exemplary of a CAR is an anti-CD19 CAR, such as a CAR containing an anti-CD19 scFv set forth in SEQ ID NO:1163 or SEQ ID NO:1174. In some embodiments, the CAR further contains a spacer, a transmembrane domain, and an intracellular signaling domain or region comprising an ITAM signaling domain, such as a CD3zeta signaling domain. In some embodiments, the CAR further includes a costimulatory signaling domain. In some embodiments, the spacer and transmembrane domain are the hinge and transmembrane domain derived from CD8, such as having an exemplary sequence set forth in SEQ ID NO: 266, 1212, 2022 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:266, 1212, 2022. In some embodiments, the endodomain comprises at CD3-zeta signaling domain. In some embodiments, the CD3-zeta signaling domain comprises the sequence of amino acids set forth in SEQ ID NO: 243 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:243 and retains the activity of T cell signaling. In some embodiments, the endodomain of a CAR can further comprise a costimulatory signaling domain or region to further modulate immunomodulatory responses of the T-cell. In some embodiments, the costimulatory signaling domain is or comprises a costimulatory region, or is derived from a costimulatory region, of CD28, ICOS, 41BB or OX40. In some embodiments, the costimulatory signaling domain is a derived from CD28 or 4-1BB and comprises the sequence of amino acids set forth in any of SEQ ID NOS: 1213-1216 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 1213-1216 and retains the activity of T cell costimulatory signaling.

In some embodiments, the construct encoding the CAR further encodes a second protein, such as a marker, e.g. detectable protein, separated from the CAR by a self-cleaving peptide sequence. In some embodiments, the self-cleaving peptide sequence is an F2A, T2A, E2A or P2A self-cleaving peptide. Exemplary sequences of a T2A self-cleaving peptide are set for the in any one of SEQ ID NOS: 1217, 1225 or 2029 or a sequence of amino acids that exhibits at least 85%, 86%, 87%, 88%, 89%, 90%, 91%, 92%, 93%, 94%, 95%, 96%, 97%, 98% or 99% or more sequence identity to any of SEQ ID NOS: 1217, 1225 or 2029. In some embodiments, the T2A is encoded by the sequence of nucleotides set forth in SEQ ID NO:1255 or a sequence that exhibits at least 85%, 86%, 87%, 88%, 89%, 90%, 91%, 92%, 93%, 94%, 95%, 96%, 97%, 98% or 99% or more sequence identity to any of SEQ ID NO: 1255. An exemplary sequence of a P2A self-cleaving peptide is set in SEQ ID NO: 2038 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NOS: 2038. In some cases, a nucleic acid construct that encodes more than one P2A self-cleaving peptide (such as a P2A1 and P2A2), in which the nucleotide sequence P2A1 and P2A2 each encode the P2A set forth in SEQ ID NO:2038, the nucleotide sequence may be different to avoid recombination between sequences.

In some embodiments, the marker is a detectable protein, such as a fluorescent protein, e.g. a green fluorescent protein (GFP) or blue fluorescent protein (BFP). Exemplary sequences of a fluorescent protein marker are set forth in SEQ ID NO:1218, 2028, or 2035-2037 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 1218, 2028, or 2035-2037.

In some embodiments, the CAR has the sequence of amino acids set forth in any of SEQ ID NOS: 1208, 1219, 1220, 1221, 2023, 2024, 2026 or 2027 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NOS: 1208, 1219, 1220, 1221, 2023, 2024, 2026 or 2027. In some embodiments, the CAR is encoded by a sequence of nucleotides set forth in SEQ ID NO: 1223 or 2025 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NO: 1223 or 2025.

In another embodiment, the engineered T-cell possesses a TCR, including a recombinant or engineered TCR. In some embodiments, the TCR can be a native TCR. Those of skill in the art will recognize that generally native mammalian T-cell receptors comprise an alpha and a beta chain (or a gamma and a delta chain) involved in antigen specific recognition and binding. In some embodiments, the TCR is an engineered TCR that is modified. In some embodiments, the TCR of an engineered T-cell specifically binds to a tumor associated or tumor specific antigen presented by an APC.

In some embodiments, the immunomodulatory polypeptides, such as transmembrane immunomodulatory polypeptides or secretable immunomodulatory polypeptides, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In typical embodiments, the nucleic acid molecule encoding the immunomodulatory protein, or the expression vector, comprises a signal peptide that localizes the expressed transmembrane immunomodulatory proteins to the cellular membrane or for secretion. In some embodiments, a nucleic acid encoding a transmembrane immunomodulatory proteins of the invention is sub-cloned into a viral vector, such as a retroviral vector, which allows expression in the host mammalian cell. The expression vector can be introduced into a mammalian host cell and, under host cell culture conditions, the immunomodulatory protein is expressed on the surface or is secreted.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule and polypeptides comprising variant PD-L2. T-cells that express the immunomodulatory polypeptide can be enriched through sorting with anti-epitope tag antibodies or enriched for high or low expression depending on the application.

Upon immunomodulatory polypeptide expression the engineered T-cell can be assayed for appropriate function by a variety of means. The engineered CAR or TCR co-expression can be validated to show that this part of the engineered T cell was not significantly impacted by the expression of the immunomodulatory protein. Once validated, standard in vitro cytotoxicity, proliferation, or cytokine assays (e.g., IFN-gamma expression) can be used to assess the function of engineered T-cells. Exemplary standard endpoints are percent lysis of the tumor line, proliferation of the engineered T-cell, or IFN-gamma protein expression in culture supernatants. An engineered construct which results in statistically significant increased lysis of tumor line, increased proliferation of the engineered T-cell, or increased IFN-gamma expression over the control construct can be selected for. Additionally, non-engineered, such as native primary or endogenous T-cells could also be incorporated into the same in vitro assay to measure the ability of the immunomodulatory polypeptide construct expressed on the engineered cells, such as engineered T-cells, to modulate activity, including, in some cases, to activate and generate effector function in bystander, native T-cells. Increased expression of activation markers such as CD69, CD44, or CD62L could be monitored on endogenous T cells, and increased proliferation and/or cytokine production could indicate desired activity of the immunomodulatory protein expressed on the engineered T cells.

In some embodiments, the similar assays can be used to compare the function of engineered T cells containing the CAR or TCR alone to those containing the CAR or TCR and a TIP construct. Typically, these in vitro assays are performed by plating various ratios of the engineered T cell and a "tumor" cell line containing the cognate CAR or TCR antigen together in culture. Standard endpoints are percent lysis of the tumor line, proliferation of the engineered T cell, or IFN-gamma production in culture supernatants. An engineered immunomodulatory protein which resulted in statistically significant increased lysis of tumor line, increased proliferation of the engineered T cell, or increased IFN-gamma production over the same TCR or CAR construct alone can be selected for. Engineered human T cells can be analyzed in immunocompromised mice, like the NSG strain, which lacks mouse T, NK and B cells. Engineered human T cells in which the CAR or TCR binds a target counter-structure on the xenograft and is co-expressed with the TIP affinity modified IgSF domain can be adoptively transferred in vivo at different cell numbers and ratios compared to the xenograft. For example, engraftment of CD19+ leukemia tumor lines containing a luciferase/GFP vector can be monitored through bioluminescence or ex vivo by flow cytometry. In a common embodiment, the xenograft is introduced into the murine model, followed by the engineered T cells several days later. Engineered T cells containing the immunomodulatory protein can be assayed for increased survival, tumor clearance, or expanded engineered T cells numbers relative to engineered T cells containing the CAR or TCR alone. As in the in vitro assay, endogenous, native (i.e., non-engineered) human T cells could be co-adoptively transferred to look for successful epitope spreading in that population, resulting in better survival or tumor clearance.

E. Infectious Agents Expressing Variant Polypeptides and Immunomodulatory Proteins Also provided are infectious agents that contain nucleic acids encoding any of the variant polypeptides, such as PD-L2 vIgD polypeptides, including secretable or transmembrane immunomodulatory proteins described herein. In some embodiments, such infectious agents can deliver the nucleic acids encoding the variant immunomodulatory polypeptides described herein, such as PD-L2 vIgD polypeptides, to a target cell in a subject, e.g., immune cell and/or antigen-presenting cell (APC) or tumor cell in a subject. Also provided are nucleic acids contained in such infectious agents, and/or nucleic acids for generation or modification of such infectious agents, such as vectors and/or plasmids, and compositions containing such infectious agents.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the variant polypeptides, such as PD-L2 vIgD polypeptides, including secretable or transmembrane immunomodulatory proteins, described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the infectious agent, e.g., virus or bacteria, contains nucleic acid sequences that encode any of the variant polypeptides, such as PD-L2 vIgD polypeptides, including secretable or transmembrane immunomodulatory proteins, described herein, and by virtue of contact and/or infection of a cell in the subject, the cell expresses the variant polypeptides, such as PD-L2 vIgD polypeptides, including secretable or transmembrane immunomodulatory proteins, encoded by the nucleic acid sequences contained in the infectious agent. In some embodiments, the infectious agent can be administered to the subject. In some embodiments, the infectious agent can be contacted with cells from the subject ex vivo.

In some embodiments, the variant polypeptides, such as PD-L2 vIgD polypeptides, including transmembrane immunomodulatory proteins, expressed by the cell infected by the infectious agent is a transmembrane protein and is surface expressed. In some embodiments, the variant polypeptides, such as PD-L2 vIgD polypeptides, including secretable immunomodulatory proteins, expressed by the cell infected by the infectious agent is expressed and secreted from the cell. The transmembrane immunomodulatory protein or secreted immunomodulatory protein can be any described herein.

In some embodiments, the cells in the subject that are targeted by the infectious agent include a tumor cell, an immune cell, and/or an antigen-presenting cell (APC). In some embodiments, the infectious agent targets a cell in the tumor microenvironment (TME). In some embodiments, the infectious agent delivers the nucleic acids encoding the variant polypeptides, such as PD-L2 vIgD polypeptides, including secretable or transmembrane immunomodulatory proteins, to an appropriate cell (for example, an APC, such as a cell that displays a peptide/WIC complex on its cell surface, such as a dendritic cell) or tissue (e.g., lymphoid tissue) that will induce and/or augment the desired effect, e.g., immunomodulation and/or a specific cell-medicated immune response, e.g., CD4 and/or CD8 T cell response, which CD8 T cell response may include a cytotoxic T cell (CTL) response. In some embodiments, the infectious agent targets an APC, such as a dendritic cell (DC). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. For example, in some embodiments, the infectious agent is an oncolytic virus and the virus can include nucleic acid sequences encoding additional therapeutic gene products (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650. In some embodiments, the additional gene product can be a therapeutic gene product that can result in death of the target cell (e.g., tumor cell) or gene products that can augment or boost or regulate an immune response (e.g., cytokine). Exemplary gene products also include among an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration and reprogramming human somatic cells to pluripotency, and other genes described herein or known to one of skill in the art. In some embodiments, the additional gene product is Granulocyte-macrophage colony-stimulating factor (GM-CSF).

1. Viruses

In some embodiments, the infectious agent is a virus. In some embodiments, the infectious agent is an oncolytic virus, or a virus that targets particular cells, e.g., immune cells. In some embodiments, the infectious agent targets a tumor cell and/or cancer cell in the subject. In some embodiments, the infectious agent targets an immune cell or an antigen-presenting cell (APC).

In some embodiments, the infectious agent is an oncolytic virus. Oncolytic viruses are viruses that accumulate in tumor cells and replicate in tumor cells. By virtue of replication in the cells, and optional delivery of nucleic acids encoding variant PD-L2 polypeptides or immunomodulatory polypeptides described herein, tumor cells are lysed, and the tumor shrinks and can be eliminated. Oncolytic viruses can also have a broad host and cell type range. For example, oncolytic viruses can accumulate in immunoprivileged cells or immunoprivileged tissues, including tumors and/or metastases, and also including wounded tissues and cells, thus allowing the delivery and expression of nucleic acids encoding the variant immunomodulatory polypeptides described herein in a broad range of cell types. Oncolytic viruses can also replicate in a tumor cell specific manner, resulting in tumor cell lysis and efficient tumor regression.

Exemplary oncolytic viruses include adenoviruses, adeno-associated viruses, herpes viruses, Herpes Simplex Virus, vesicular stomatic virus, Reovirus, Newcastle Disease virus, parvovirus, measles virus, vesicular stomatitis virus (VSV), Coxsackie virus and Vaccinia virus. In some embodiments, oncolytic viruses can specifically colonize solid tumors, while not infecting other organs, and can be used as an infectious agent to deliver the nucleic acids encoding the variant immunomodulatory polypeptides described herein to such solid tumors.

Oncolytic viruses for use in delivering the nucleic acids encoding variant PD-L2 polypeptides or immunomodulatory polypeptides described herein, can be any of those known to one of skill in the art and include, for example, vesicular stomatitis virus, see, e.g., U.S. Pat. Nos. 7,731,974, 7,153,510, 6,653,103 and U.S. Pat. Pub. Nos. 2010/0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos., 2014/0154216, 2011/0177032, 2011/0158948, 2010/0092515, 2009/0274728, 2009/0285860, 2009/0215147, 2009/0010889, 2007/0110720, 2006/0039894, 2004/0009604, 2004/0063094, International Patent Pub. Nos., WO 2007/052029, WO 1999/038955; retroviruses, see, e.g., U.S. Pat. Nos. 6,689,871, 6,635,472, 5,851,529, 5,716,826, 5,716,613 and U.S. Pat. Pub. No. 20110212530; vaccinia viruses, see, e.g., 2016/0339066, and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670.

Oncolytic viruses also include viruses that have been genetically altered to attenuate their virulence, to improve their safety profile, enhance their tumor specificity, and they have also been equipped with additional genes, for example cytotoxins, cytokines, prodrug converting enzymes to improve the overall efficacy of the viruses (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650). In some embodiments, the oncolytic viruses can be those that have been modified so that they selectively replicate in cancerous cells, and, thus, are oncolytic. For example, the oncolytic virus is an adenovirus that has been engineered to have modified tropism for tumor therapy and also as gene therapy vectors. Exemplary of such is ONYX-015, H101 and Ad5ΔCR (Hallden and Portella (2012) Expert Opin Ther Targets, 16:945-58) and TNFerade (McLoughlin et al. (2005) Ann. Surg. Oncol., 12:825-30), or a conditionally replicative adenovirus Oncorine®.

In some embodiments, the infectious agent is a modified herpes simplex virus. In some embodiments, the infectious agent is a modified version of Talimogene laherparepvec (also known as T-Vec, Imlygic or OncoVex GM-CSF), that is modified to contain nucleic acids encoding any of the variant immunomodulatory polypeptides described herein, such as variant PD-L2 or immunomodulatory polypeptides described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, the infectious agent is a virus that targets a particular type of cells in a subject that is administered the virus, e.g., a virus that targets immune cells or antigen-presenting cells (APCs). Dendritic cells (DCs) are essential APCs for the initiation and control of immune responses. DCs can capture and process antigens, migrate from the periphery to a lymphoid organ, and present the antigens to resting T cells in a major histocompatibility complex (MHC)-restricted fashion. In some embodiments, the infectious agent is a virus that specifically can target DCs to deliver nucleic acids encoding the variant PD-L2 polypeptides or immunomodulatory polypeptides for expression in DCs. In some embodiments, the virus is a lentivirus or a variant or derivative thereof, such as an integration-deficient lentiviral vector. In some embodiments, the virus is a lentivirus that is pseudotyped to efficiently bind to and productively infect cells expressing the cell surface marker dendritic cell-specific intercellular adhesion molecule-3-grabbing non-integrin (DC-SIGN), such as DCs. In some embodiments, the virus is a lentivirus pseudotyped with a Sindbis virus E2 glycoprotein or modified form thereof, such as those described in WO 2013/149167. In some embodiments, the virus allows for delivery and expression of a sequence of interest (e.g., a nucleic acid encoding any of the variant PD-L2 polypeptides or immunomodulatory polypeptides described herein) to a DC. In some embodiments, the virus includes those described in WO 2008/011636 or US 2011/0064763, Tareen et al. (2014) Mol. Ther., 22:575-587, or variants thereof. Exemplary of a dendritic cell-tropic vector platform is ZVex™.

2. Bacteria

In some embodiments, the infectious agent is a bacterium. For example, in some embodiments, the bacteria can deliver nucleic acids encoding any of the variant PD-L2 polypeptides or immunomodulatory polypeptides described herein to a target cell in the subject, such as a tumor cell, an immune cell, an antigen-presenting cell and/or a phagocytic cell. In some embodiments, the bacterium can be preferentially targeted to a specific environment within a subject, such as a tumor microenvironment (TME), for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., tumor cells) and/or to phagocytic cells, e.g., certain immune cells and/or APCs. In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., tumor cells. In some embodiments, the bacterium can contain and/or release nucleic acid sequences and/or gene products in the cytoplasm of the target cells, thereby killing the target cell, e.g., tumor cell. In some embodiments, the infectious agent is bacterium that can replicate specifically in a particular environment in the subject, e.g., tumor microenvironment (TME). For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the TME, can act as chemoattractants to attract the bacterium to the environment. In some embodiments, the bacterium can express and/or secrete the immunomodulatory proteins described herein in the environment, e.g., TME.

In some embodiments, the infectious agent is a bacterium that is a *Listeria* sp., a *Bifidobacterium* sp., an *Escherichia* sp., a *Closteridium* sp., a *Salmonella* sp., a *Shigella* sp., a *Vibrio* sp. or a *Yersinia* sp. In some embodiments, the bacterium is selected from among one or more of *Listeria monocytogenes, Salmonella typhimurium, Salmonella choleraesuis, Escherichia coli, Vibrio cholera, Clostridium perfringens, Clostridium butyricum, Clostridium novyi, Clostridium acetobutylicum, Bifidobacterium infantis, Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009) Molecular Therapy 17(5):767-777; Baban et al.

(2010) Bioengineered Bugs 1:6, 385-394; Patyar et al. (2010) J Biomed Sci 17:21; Tangney et al. (2010) Bioengineered Bugs 1:4, 284-287; van Pijkeren et al. (2010) Hum Gene Ther. 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

F. Nucleic Acids, Vectors and Methods for Producing the Polypeptides or Cells

Provided herein are isolated or recombinant nucleic acids collectively referred to as "nucleic acids" which encode any of the various provided embodiments of the variant PD-L2 polypeptides or immunomodulatory polypeptides provided herein. In some embodiments, nucleic acids provided herein, including all described below, are useful in recombinant production (e.g., expression) of variant PD-L2 polypeptides or immunomodulatory polypeptides provided herein. In some embodiments, nucleic acids provided herein, including all described below, are useful in expression of variant PD-L2 polypeptides or immunomodulatory polypeptides provided herein in cells, such as in engineered cells, e.g. immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the variant PD-L2 polypeptides or immunomodulatory polypeptides provided herein.

Also provided herein are engineered cells, such as engineered immune cells, containing any of the provided nucleic acid molecules or encoded variant PD-L2 polypeptides or immunomodulatory polypeptides, such as any of the transmembrane immunomodulatory polypeptides or secretable immunomodulatory polypeptides.

Also provided herein are infectious agents, such as bacterial or viral cells, containing any of the provided nucleic acid molecules or encoded variant PD-L2 polypeptides or immunomodulatory polypeptides, such as any of the transmembrane immunomodulatory polypeptides or secretable immunomodulatory polypeptides.

In any of the above provided embodiments, the nucleic acids encoding the immunomodulatory polypeptides provided herein can be introduced into cells using recombinant DNA and cloning techniques. To do so, a recombinant DNA molecule encoding a immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more variant PD-L2 polypeptides containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promoter (such as a tissue-specific constitutively active promotor or other constitutive promotor). In some embodiments, the promotor is an inducible promotor, which may be responsive to an inducing agent (such as a T cell activation signal).

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EF1a) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g. published International PCT Appl. No. WO 01/30843), to allow regulated expression of the encoded polypeptide. An exemplary regulatable promoter system is the Tet-On (and Tet-Off) system available, for example, from Clontech (Palo Alto, Calif.). This promoter system allows the regulated expression of the transgene controlled by tetracycline or tetracycline derivatives, such as doxycycline. Other regulatable promoter systems are known (see e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors).

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promoter.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof. "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. In some embodiments, the host cell is a suspension cell and the polypeptide is engineered or produced in cultured suspension, such as in cultured suspension CHO cells, e.g. CHO-S cells. In some examples, the cell line is a CHO cell line that is deficient in DHFR (DHFR−), such as DG44 and DUXB11. In some embodiments, the cell is deficient in glutamine synthase (GS), e.g. CHO-S cells, CHOK1 SV cells, and CHOZN((R)) GS−/− cells. In some embodiments, the CHO cells, such as suspension CHO cells, may be CHO-S-2H2 cells, CHO-S-clone 14 cells, or ExpiCHO-S cells.

In some embodiments, host cells can also be prokaryotic cells, such as with *E. coli*. The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cells, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g. transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequences encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., J. Virol. 80:985-98 (2006); Tartaglia et al., AIDS Research and Human Retroviruses 8: 1445-47 (1992); Gheradi et al., J. Gen. Virol. 86:2925-36 (2005); Mayr et al., Infection 3:6-14 (1975); Hu et al., J. Virol. 75: 10300-308 (2001); U.S. Pat. Nos. 5,698,530, 6,998,252, 5,443,964, 7,247,615 and 7,368,116); adenovirus vector or adenovirus-associated virus vectors (see, e.g., Molin et al., J. Virol. 72:8358-61 (1998); Narumi et al., Am J. Respir. Cell Mol. Biol. 19:936-41 (1998); Mercier et al., Proc. Natl. Acad. Sci. USA 101:6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., J. Virol. 66:2731-39 (1992); Johann et al., J. Virol. 66: 1635-40 (1992); Sommerfelt et al., Virology 176:58-59 (1990); Wilson et al., J. Virol. 63:2374-78 (1989); Miller et al., J. Virol. 65:2220-24 (1991); Miller et al., Mol. Cell Biol. 10:4239 (1990); Kolberg, NIH Res. 4:43 1992; Cornetta et al., Hum. Gene Ther. 2:215 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer et al., Annu. Rev. Genomics Hum. Genet. 2: 177-211 (2001); Zufferey et al., J. Virol. 72: 9873, 1998; Miyoshi et al., J. Virol. 72:8150, 1998; Philpott and Thrasher, Human Gene Therapy 18:483, 2007; Engelman et al., J. Virol. 69: 2729, 1995; Nightingale et al., Mol. Therapy, 13: 1121, 2006; Brown et al., J. Virol. 73:9011 (1999); WO 2009/076524; WO 2012/141984; WO 2016/011083; McWilliams et al., J. Virol. 77: 11150, 2003; Powell et al., J. Virol. 70:5288, 1996) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promotor is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., Mol. Cell. Biol. 12:1043-53 (1992); Todd et al., J. Exp. Med. 177: 1663-74 (1993); Penix et al., J. Exp. Med. 178:1483-96 (1993)). In some embodiments, the promotor is an inducible promotor, which may be responsive to an inducing agent (such as a T cell activation signal). In some embodiments, nucleic acids delivered to the target cell in the subject, e.g., tumor cell, immune cell and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., tumor cells, immune cells and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

IV. METHODS OF ASSESSING ACTIVITY IMMUNE MODULATION OF VARIANT PD-L2 POLYPEPTIDES AND IMMUNOMODULATORY PROTEINS

In some embodiments, the variant PD-L2 polypeptides provided herein (e.g. full-length and/or specific binding fragments or conjugates, stack constructs or fusion thereof, engineered cells or infectious agents) exhibit immunomodulatory activity to modulate T cell activation. In some embodiments, PD-L2 polypeptides modulate IFN-gamma expression in a T cell assay relative to a wild-type or unmodified PD-L2 control. In some cases, modulation of IFN-gamma expression can increase or decrease IFN-gamma expression relative to the control. Assays to determine specific binding and IFN-gamma expression are well-known in the art and include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9):846-56), and anti-CD3 T cell stimulation assays (Li and Kurlander, J Transl Med. 2010: 8: 104).

In some embodiments, a variant PD-L2 polypeptide can in some embodiments increase or, in alternative embodiments, decrease IFN-gamma (interferon-gamma) expression in a primary T-cell assay relative to a wild-type PD-L2 control. In some embodiments, such activity may depend on whether the variant PD-L2 polypeptide is provided in a form for antagonist activity or in a form for agonist activity. In some embodiments, a variant PD-L2 polypeptide or immunomodulatory protein is an antagonist of the inhibitory receptor, such as blocks an inhibitory signal in the cell that may occur to decrease response to activating stimuli, e.g. CD3 and/or CD28 costimulatory signal or a mitogenic signal. Those of skill will recognize that different formats of the primary T-cell assay used to determine an increase or decrease in IFN-gamma expression exist.

In assaying for the ability of a variant PD-L2 to increase or decrease IFN-gamma expression in a primary T-cell assay, a Mixed Lymphocyte Reaction (MLR) assay can be used. In some embodiments, a variant PD-L2 polypeptide or immunomodulatory protein provided in antagonist form, such as soluble form, e.g. variant PD-L2-Fc or secretable immunomodulatory protein, block activity of the PD-1 inhibitory receptor and thereby increase MLR activity in the assay, such as observed by increased production of IFN-gamma in the assay. In some embodiments, a variant PD-L2 polypeptide or immunomodulatory protein provided in agonist form, such as a localizing vIgD stack or conjugate containing a tumor-localizing moiety or an engineered cell expressing a transmembrane immunomodulatory protein as provided, may stimulate activity of the PD-1 inhibitory receptor and thereby decrease MLR activity, such as evidenced by decreased IFN-gamma production. In some embodiments, a variant PD-L2 polypeptide or immunomodulatory protein provided in agonist form, such as a localizing vIgD stack or conjugate containing a tumor-localizing moiety or an engineered cell expressing a transmembrane immunomodulatory protein as provided, may block activity of the PD-1 inhibitory receptor and thereby increase MLR activity, such as increase IFN-gamma production.

Alternatively, in assaying for the ability of a variant PD-L2 to modulate an increase or decrease IFN-gamma expression in a primary T-cell assay, a co-immobilization assay can be used. In a co-immobilization assay, a TCR signal, provided in some embodiments by anti-CD3 antibody, is used in conjunction with a co-immobilized variant PD-L2 to determine the ability to increase or decrease IFN-gamma expression relative to a PD-L2 unmodified or wild-type control. In some embodiments, a variant PD-L2 polypeptide or immunomodulatory protein, e.g. a co-immobilized variant PD-L2-Fc, decreases IFN-gamma production in a co-immobilization assay.

In some embodiments, in assaying for the ability of a variant PD-L2 to modulate an increase or decrease IFN-gamma expression a T cell reporter assay can be used. In some embodiments, the T cell is a Jurkat T cell line or is derived from Jurkat T cell lines. In reporter assays, the reporter cell line (e.g. Jurkat reporter cell) also is generated to overexpress an inhibitory receptor that is the cognate binding partner of the variant IgSF domain polypeptide. For example, in the case of a variant PD-L2, the reporter cell line (e.g. Jurkat reporter cell) is generated to overexpress PD-1. In some embodiments, the reporter T cells also contain a reporter construct containing an inducible promoter responsive to T cell activation operably linked to a reporter. In some embodiments, the reporter is a fluorescent or luminescent reporter. In some embodiments, the reporter is luciferase. In some embodiments, the promoter is responsive to CD3 signaling. In some embodiments, the promoter is an NFAT promoter. In some embodiments, the promoter is responsive to costimulatory signaling, e.g. CD28 costimulatory signaling. In some embodiments, the promoter is an IL-2 promoter.

In aspects of a reporter assay, a reporter cell line is stimulated, such as by co-incubation with antigen presenting cells (APCs) expressing the wild-type ligand of the inhibitory receptor, e.g. PD-L2. In some embodiments, the APCs are artificial APCs. Artificial APCs are well known to a skilled artisan. In some embodiments, artificial APCs are derived from one or more mammalian cell line, such as K562, CHO or 293 cells.

In some embodiments, the Jurkat reporter cells are co-incubated with artificial APCs overexpressing the inhibitory ligand in the presence of the variant IgSF domain molecule or immunomodulatory protein, e.g., variant PD-L2 polypeptide or immunomodulatory protein. In some embodiments, reporter expression is monitored, such as by determining the luminescence or fluorescence of the cells. In some embodiments, normal interactions between its inhibitory receptor and ligand result in a repression of or decrease in the reporter signal, such as compared to control, e.g. reporter expression by co-incubation of control T cells and APCs in which the inhibitory receptor and ligand interaction is not present, e.g. APCs that do not overexpress PD-L2. In some embodiments, a variant PD-L2 polypeptide or immunomodulatory protein provided herein antagonizes the interaction, e.g. when provided in soluble form as a variant PD-L2-Fc or when expressed from the APC as a secretable immunomodulatory protein, thereby resulting in an increase in the reporter signal compared to the absence of the variant PD-L2 polypeptide or immunomodulatory protein. In some cases, certain formats of a variant PD-L2 polypeptide or immunomodulatory protein as provided herein may provide an agonist activity, thereby decreasing reporter expression compared to the absence of the variant PD-L2 polypeptide or immunomodulatory protein.

Use of proper controls is known to those of skill in the art, however, in the aforementioned embodiments, a control typically involves use of the unmodified PD-L2, such as a wild-type of native PD-L2 isoform from the same mammalian species from which the variant PD-L2 was derived or developed. In some embodiments, the wild-type or native PD-L2 is of the same form or corresponding form as the variant. For example, if the variant PD-L2 is a soluble form containing a variant ECD fused to an Fc protein, then the control is a soluble form containing the wild-type or native ECD of PD-L2 fused to the Fc protein. Irrespective of whether the binding affinity and/or selectivity to PD-1 is increased or decreased, a variant PD-L2 in some embodiments will increase IFN-gamma expression and, in alternative embodiments, decrease IFN-gamma expression in a T-cell assay relative to a wild-type PD-L2 control.

In some embodiments, a variant PD-L2 polypeptide or immunomodulatory protein, increases IFN-gamma expression (i.e., protein expression) relative to a wild-type or unmodified PD-L2 control by at least: 5%, 10%, 20%, 30%, 40%, 50%, 60%, 70%, 80%, 90%, or higher. In other embodiments, a variant PD-L2 or immunomodulatory protein decreases IFN-gamma expression (i.e. protein expression) relative to a wild-type or unmodified PD-L2 control by at least: 5%, 10%, 20%, 30%, 40%, 50%, 60%, 70%, 80%, 90%, or higher. In some embodiments, the wild-type PD-L2 control is murine PD-L2, such as would typically be used for a variant PD-L2 altered in sequence from that of a wild-type murine PD-L2 sequence. In some embodiments, the wild-type PD-L2 control is human PD-L2, such as would typically be used for a variant PD-L2 altered in sequence from that of a wild-type human PD-L2 sequence.

V. PHARMACEUTICAL FORMULATIONS

Provided herein are compositions containing any of the variant PD-L2 polypeptides, immunomodulatory proteins, conjugates, engineered cells or infectious agents described herein. The pharmaceutical composition can further comprise a pharmaceutically acceptable excipient. For example, the pharmaceutical composition can contain one or more excipients for modifying, maintaining or preserving, for example, the pH, osmolarity, viscosity, clarity, color, isotonicity, odor, sterility, stability, rate of dissolution or release, adsorption, or penetration of the composition. In some aspects, a skilled artisan understands that a pharmaceutical composition containing cells may differ from a pharmaceutical composition containing a protein.

In some embodiments, the pharmaceutical composition is a solid, such as a powder, capsule, or tablet. For example, the components of the pharmaceutical composition can be lyophilized. In some embodiments, the solid pharmaceutical composition is reconstituted or dissolved in a liquid prior to administration.

In some embodiments, the pharmaceutical composition is a liquid, for example variant PD-L2 polypeptides dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrystalline cellulose, sucrose, lactose, glucose, mannitol, sorbitol, maltol, pregelatinized starch, corn starch, or potato starch. Examples of pharmaceutically-acceptable binders include polyvinylpyrrolidone, starch, lactose, xylitol, sorbitol, maltitol, gelatin, sucrose, polyethylene glycol, methyl cellulose, or cellulose. Examples of pharmaceutically-acceptable coatings include hydroxypropyl methylcellulose (HPMC), shellac, corn protein zein, or gelatin. Examples of pharmaceutically-acceptable disintegrants include polyvinylpyrrolidone, carboxymethyl cellulose, or sodium starch glycolate. Examples of pharmaceutically-acceptable lubricants include polyethylene glycol, magnesium stearate, or stearic acid. Examples of pharmaceutically-acceptable preservatives include methyl parabens, ethyl parabens, propyl paraben, benzoic acid, or sorbic acid. Examples of pharmaceutically-acceptable sweetening agents include sucrose, saccharine, aspartame, or sorbitol. Examples of pharmaceutically-acceptable buffering agents include carbonates, citrates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral administration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical compositions containing the transmembrane immunomodulatory proteins, including engineered cells expressing such transmembrane immunomodulatory proteins. In some embodiments, the pharmaceutical compositions and formulations include one or more optional pharmaceutically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

VI. ARTICLES OF MANUFACTURE AND KITS

Also provided herein are articles of manufacture comprising the pharmaceutical compositions described herein in suitable packaging. Suitable packaging for compositions (such as ophthalmic compositions) described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

VII. THERAPEUTIC APPLICATIONS

Provided herein are methods using the provided pharmaceutical compositions containing a variant PD-L2 polypeptide, immunomodulatory protein, conjugate, engineered cell or infectious agent described herein, for modulating an immune response, including in connection with treating a disease or condition in a subject, such as in a human patient. The pharmaceutical compositions described herein (including pharmaceutical composition comprising the variant PD-L2 polypeptides, the immunomodulatory proteins, the conjugates, the engineered cells or the infectious agents described herein) can be used in a variety of therapeutic applications, such as the treatment of a disease. For example, in some embodiments the pharmaceutical composition is used to treat inflammatory or autoimmune disorders, cancer, organ transplantation, viral infections, and/or bacterial infections in a mammal. The pharmaceutical composition can modulate (e.g. increase or decrease) an immune response to treat the disease.

In some embodiments, the provided methods are applicable to therapeutic administration of variant PD-L2 polypeptides, the immunomodulatory proteins, the conjugates, the engineered cells and infectious agents described herein. It is within the level of a skilled artisan, in view of the provided disclosure, to choose a format for the indication depending on the type of modulation of the immune response, e.g. increase or decrease that is desired.

In some embodiments, a pharmaceutical composition provided herein that stimulates the immune response is administered, which can be useful, for example, in the treatment of cancer, viral infections, or bacterial infections. In some embodiments, the pharmaceutical composition contains a variant PD-L2 polypeptide in a format that exhibits antagonist activity of its cognate binding partner PD-1 and/or that inhibits costimulatory signaling via PD-1. Exemplary formats of PD-L2 polypeptide for use in connection with such therapeutic applications include, for example, a variant PD-L2 polypeptide that is soluble (e.g. variant PD-L2-Fc fusion protein), an immunomodulatory protein or "stack" of a variant PD-L2 polypeptide and another IgSF domain, including soluble forms thereof that are Fc fusions, an engineered cell expressing a secretable immunomodulatory protein, or an infectious agent comprising a nucleic acid molecule encoding a secretable immunomodulatory protein, such as for expression and secretion of the secretable immunomodulatory protein in an infected cell (e.g. tumor cell or APC, e.g. dendritic cell). Among such methods are methods carried out by delivery of a variant PD-L2 polypeptide in a soluble format. Exemplary soluble formats are described herein, including formats in which an extracellular portion of a variant PD-L2 polypeptide containing an affinity modified IgSF domain (e.g. IgV) is linked, directly or indirectly, to a multimerization domain, e.g. an Fc domain or region. In some embodiments, such a therapeutic agent is a variant PD-L2-Fc fusion protein.

The provided methods to modulate an immune response can be used to treat a disease or condition, such as a tumor or cancer. In some embodiments, the pharmaceutical composition can be used to inhibit growth of mammalian cancer cells (such as human cancer cells). A method of treating cancer can include administering an effective amount of any of the pharmaceutical compositions described herein to a subject with cancer. The effective amount of the pharmaceutical composition can be administered to inhibit, halt, or reverse progression of cancers, including cancers that are sensitive to modulation of immunological activity, such as by the provided variants or immunomodulatory proteins. Human cancer cells can be treated in vivo, or ex vivo. In ex vivo treatment of a human patient, tissue or fluids containing cancer cells are treated outside the body and then the tissue or fluids are reintroduced back into the patient. In some embodiments, the cancer is treated in a human patient in vivo by administration of the therapeutic composition into the patient. Thus, the present invention provides ex vivo and in vivo methods to inhibit, halt, or reverse progression of the tumor, or otherwise result in a statistically significant increase in progression-free survival (i.e., the length of time during and after treatment in which a patient is living with cancer that does not get worse), or overall survival (also called "survival rate;" i.e., the percentage of people in a study or treatment group who are alive for a certain period of time after they were diagnosed with or treated for cancer) relative to treatment with a control.

The cancers that can be treated by the pharmaceutical compositions and the treatment methods described herein include, but are not limited to, melanoma, bladder cancer, hematological malignancies (leukemia, lymphoma, myeloma), liver cancer, brain cancer, renal cancer, breast cancer, pancreatic cancer (adenocarcinoma), colorectal cancer, lung cancer (small cell lung cancer and non-small-cell lung cancer), spleen cancer, cancer of the thymus or blood cells (i.e., leukemia), prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some embodiments, the cancer is Ewing's sarcoma. In some embodiments, the cancer is a lymphoma, lymphoid leukemia, myeloid leukemia, cervical cancer, neuroblastoma, or multiple myeloma.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy. In some aspects of the present disclosure, the immune checkpoint inhibitor is nivolumab, tremelimumab, pembrolizumab, ipilimumab, or the like.

In some embodiments, the pharmaceutical composition suppresses an immune response, which can be useful in the treatment of inflammatory or autoimmune disorders, or organ transplantation. In some embodiments, the pharmaceutical composition contains a variant PD-L2 polypeptide in a format that exhibits agonist activity of its cognate binding partner PD-1 and/or that stimulates inhibitory signaling via PD-1. Exemplary formats of a PD-L2 polypeptide for use in connection with such therapeutic applications include, for example, an immunomodulatory protein or "stack" of a variant PD-L2 polypeptide and an IgSF domain or variant thereof that localizes to a cell or tissue of an inflammatory environment, a conjugate containing a variant PD-L2 polypeptide linked to a moiety that localizes to a cell or tissue of an inflammatory environment, an engineered cell expressing a transmembrane immunomodulatory protein, or an infectious agent comprising a nucleic acid molecule encoding a transmembrane immunomodulatory protein, such as for expression of the transmembrane immunomodulatory protein in an infected cell.

The provided methods to modulate an immune response can be used to treat a disease or condition, such as an inflammatory or autoimmune disorder. In some embodiments, the inflammatory or autoimmune disorder is Anti-neutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

In some embodiments, the inflammatory and autoimmune disorders that can be treated by the pharmaceutical composition described herein is Addison's Disease, allergies, alopecia areata, Alzheimer's, antineutrophil cytoplasmic antibodies (ANCA)-associated vasculitis, ankylosing spondylitis, antiphospholipid syndrome (Hughes Syndrome), asthma, atherosclerosis, rheumatoid arthritis, autoimmune hemolytic anemia, autoimmune hepatitis, autoimmune inner ear disease, autoimmune lymphoproliferative syndrome, autoimmune myocarditis, autoimmune oophoritis, autoimmune orchitis, azoospermia, Behcet's Disease, Berger's Disease, bullous pemphigoid, cardiomyopathy, cardiovascular disease, celiac Sprue/coeliac disease, chronic fatigue immune dysfunction syndrome (CFIDS), chronic idiopathic polyneuritis, chronic inflammatory demyelinating, polyradicalneuropathy (CIDP), chronic relapsing polyneuropathy (Guillain-Barré syndrome), Churg-Strauss Syndrome (CSS), cicatricial pemphigoid, cold agglutinin disease (CAD), COPD (chronic obstructive pulmonary disease), CREST syndrome, Crohn's disease, dermatitis, herpetiformus, dermatomyositis, diabetes, discoid lupus, eczema, epidermolysis bullosa acquisita, essential mixed cryoglobulinemia, Evan's Syndrome, exopthalmos, fibromyalgia, Goodpasture's Syndrome, Graves' Disease, Hashimoto's thyroiditis, idiopathic pulmonary fibrosis, idiopathic thrombocytopenia purpura (ITP), IgA nephropathy, immunoproliferative disease or disorder, inflammatory bowel disease (IBD), interstitial lung disease, juvenile arthritis, juvenile idiopathic arthritis (JIA), Kawasaki's Disease, Lambert-Eaton Myasthenic Syndrome, lichen planus, lupus nephritis, lymphocytic hypophysitis, Meniere's Disease, Miller Fish Syndrome/acute disseminated encephalomyeloradiculopathy, mixed connective tissue disease, multiple sclerosis (MS), muscular rheumatism, myalgic encephalomyelitis (ME), myasthenia gravis, ocular inflammation, pemphigus foliaceus, pemphigus vulgaris, pernicious anaemia, polyarteritis nodosa, polychondritis, polyglandular syndromes (Whitaker's syndrome), polymyalgia rheumatica, polymyositis, primary agammaglobulinemia, primary biliary cirrhosis/autoimmune cholangiopathy, psoriasis, psoriatic arthritis, Raynaud's Phenomenon, Reiter's Syndrome/reactive arthritis, restenosis, rheumatic fever, rheumatic disease, sarcoidosis, Schmidt's syndrome, scleroderma, Sjörgen's Syndrome, stiff-man syndrome, systemic lupus erythematosus (SLE), systemic scleroderma, Takayasu arteritis, temporal arteritis/giant cell arteritis, thyroiditis, Type 1 diabetes, ulcerative colitis, uveitis, vasculitis, vitiligo, interstitial bowel disease or Wegener's Granulomatosis. In some embodiments, the inflammatory or autoimmune disorder is selected from interstitial bowel disease, transplant, Crohn's disease, ulcerative colitis, multiple sclerosis, asthma, rheumatoid arthritis, and psoriasis.

In some embodiments, the pharmaceutical composition is administered to modulate an autoimmune condition. For example, suppressing an immune response can be beneficial in methods for inhibiting rejection of a tissue, cell, or organ transplant from a donor by a recipient. Accordingly, in some embodiments, the pharmaceutical compositions described herein are used to limit or prevent graft-related or transplant related diseases or disorders, such as graft versus host disease (GVHD). In some embodiments, the pharmaceutical compositions are used to suppress autoimmune rejection of transplanted or grafted bone marrow, organs, skin, muscle, neurons, islets, or parenchymal cells.

Pharmaceutical compositions comprising engineered cells and the methods described herein can be used in adoptive cell transfer applications. In some embodiments, cell compositions comprising engineered cells can be used in associated methods to, for example, modulate immunological activity in an immunotherapy approach to the treatment of, for example, a mammalian cancer or, in other embodiments the treatment of autoimmune disorders. The methods employed generally comprise a method of contacting a TIP of the present invention with a mammalian cell under conditions that are permissive to specific binding of the affinity modified IgSF domain and modulation of the immunological activity of the mammalian cell. In some embodiments, immune cells (such as tumor infiltrating lymphocytes (TILs), T-cells (including CD8+ or CD4+ T-cells), or APCs) are engineered to express as a membrane protein and/or as a soluble variant PD-L2 polypeptide, immunomodulatory protein, or conjugate as described herein. The engineered cells can then be contact a mammalian cell, such as an APC, a second lymphocyte or tumor cell in which modulation of immunological activity is desired and under conditions that are permissive of specific binding of the affinity modified IgSF domain to a counter-structure on the mammalian cell such that immunological activity can be modulated in the mammalian cell. Cells can be contacted in vivo or ex vivo.

In some embodiments, the engineered cells are autologous cells. In other embodiments, the cells are allogeneic. In some embodiments, the cells are autologous engineered cells reinfused into the mammal from which it was isolated. In some embodiments, the cells are allogenic engineered cells infused into the mammal. In some embodiments, the cells are harvested from a patient's blood or tumor, engineered to express a polypeptide (such as the variant PD-L2 polypeptide, immunomodulatory protein, or conjugate as described herein), expanded in an in vitro culture system (for example, by stimulating the cells), and reinfused into the patient to mediate tumor destruction. In some embodiments, the methods are conducted by adoptive cell transfer wherein cells expressing the TIP (e.g., a T-cell) are infused back into the patient. In some embodiments, the therapeutic compositions and methods of the invention are used in the treatment of a mammalian patient of cancers such as lymphoma, lymphoid leukemia, myeloid leukemia, cervical cancer, neuroblastoma, or multiple myeloma.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-α, IFN-γ, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject by any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 μg of protein per kg subject body mass or more (such as about 2 μg of protein per kg subject body mass or more, about 5 μg of protein per kg subject body mass or more, about 10 of protein per kg subject body mass or more, about 25 μg of protein per kg subject body mass or more, about 50 μg of protein per kg subject body mass or more, about 100 μg of protein per kg subject body mass or more, about 250 μg of protein per kg subject body mass or more, about 500 of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g. T cells, as described herein may be administered at a dosage of $10^4$ to $10^9$ cells/kg body weight, such as $10^5$ to $10^6$ cells/kg body weight, including all integer values within those ranges. Engineered cell compositions, such as T cell compositions, may also be administered multiple times at these dosages. The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about 1×10⁵ and about 1×10¹² plaque-forming units (pfu), 1×10⁶ and 1×10¹⁰ pfu, or 1×10⁷ and 1×10¹⁰ pfu, each inclusive, such as at least or at least about or at about 1×10⁶, 1×10⁷, 1×10⁸, 1×10⁹, 2×10⁹, 3×10⁹, 4×10⁹, 5×10⁹ pfu or about 1×10¹⁰ pfu. In some embodiments, the pharmaceutical composition can contain a virus concentration of from or from about 10⁵ to about 10¹⁰ pfu/mL, for example, 5×10⁶ to 5×10⁹ or 1×10⁷ to 1×10⁹ pfu/mL, such as at least or at least about or at about 10⁶ pfu/mL, 10⁷ pfu/mL, 10⁸ pfu/mL or 10⁹ pfu/mL. In some embodiments, the pharmaceutical composition contains an infectious agent that is a bacterium, at a single or multiple dosage amount, of between about between or between about 1×10³ and about 1×10⁹ colony-forming units (cfu), 1×10⁴ and 1×10⁹ cfu, or 1×10⁵ and 1×10⁷ cfu, each inclusive, such as at least or at least about or at about 1×10⁴, 1×10⁵, 1×10⁶, 1×10⁷, 1×10⁸ or 1×10⁹ cfu. In some embodiments, the pharmaceutical composition can contain a bacterial concentration of from or from about 10³ to about 10⁸ cfu/mL, for example, 5×10⁵ to 5×10⁷ or 1×10⁶ to 1×10⁷ cfu/mL, such as at least or at least about or at about 10⁵ cfu/mL, 10⁶ cfu/mL, 10⁷ cfu/mL or 10⁸ cfu/mL.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional, profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or self-polypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VIII. EXEMPLARY EMBODIMENTS

Among the provided embodiments are:

1. A variant PD-L2 polypeptide, comprising an IgV domain or a specific binding fragment thereof, an IgC domain or a specific binding fragment thereof, or both, wherein the variant PD-L2 polypeptide comprises one or more amino acid modifications at one or more positions in an unmodified PD-L2 or a specific binding fragment thereof corresponding to position(s) selected from 2, 12, 13, 15, 18, 23, 24, 28, 31, 32, 33, 36, 37, 39, 44, 45, 46, 47, 48, 58, 59, 65, 67, 69, 71, 72, 73, 74, 75, 76, 77, 82, 85, 86, 89, or 91 with reference to numbering of SEQ ID NO:31.

2. The variant PD-L2 polypeptide of embodiment 1, wherein the amino acid modification is an amino acid substitution, insertion or deletion.

3. The variant PD-L2 polypeptide of embodiment 1 or embodiment 2, wherein the unmodified PD-L2 is a mammalian PD-L2 or a specific binding fragment thereof.

4. The variant PD-L2 polypeptide of any of embodiments 1-3, wherein the unmodified PD-L2 is a human PD-L2 or a specific binding fragment thereof.

5. The variant PD-L2 polypeptide of any one of embodiments 1-4, wherein the unmodified PD-L2 comprises (i) the sequence of amino acids set forth in SEQ ID NO:31, (ii) a sequence of amino acids that has at least 95% sequence identity to SEQ ID NO:31; or (iii) a portion thereof comprising an IgV domain or IgC domain or specific binding fragments thereof or both.

6. The variant PD-L2 polypeptide of any one of embodiments 1-5, wherein:
the specific binding fragment of the IgV domain or IgC domain has a length of at least 50, 60, 70, 80, 90, 100, 110 or more amino acids; or
the specific binding fragment of the IgV domain comprises a length that is at least 80% of the length of the IgV domain set forth as amino acids 24-130 of SEQ ID NO:4 and/or the specific binding fragment of the IgC domain comprises a length that is at least 80% of the length of the IgC domain set forth as amino acids 122-203 of SEQ ID NO:4.

7. The variant PD-L2 polypeptide of any one of embodiments 1-6, wherein:
the variant PD-L2 comprises up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions; or
the variant PD-L2 polypeptide comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:31 or a specific binding fragment thereof.

8. The variant PD-L2 polypeptide of any of embodiments 1-7, wherein the variant PD-L2 polypeptide exhibits altered binding to the ectodomain of PD-1 or RGMb compared to the unmodified PD-L2.

9. The variant PD-L2 polypeptide of any of embodiments 1-8, wherein the variant PD-L2 polypeptide exhibits altered binding to the ectodomain of PD-1 compared to the unmodified PD-L2.

10. The variant PD-L2 polypeptide of embodiment 8 or embodiment 9, wherein the altered binding is altered binding affinity and/or altered binding selectivity.

11. The variant PD-L2 polypeptide of any of embodiments 1-10, wherein the one or more amino acid modifications are selected from F2L, I12V, I13V, H15Q, N18D, N24S, C23S, G28V, N24D, V31A, V31M, N32D, L33P, L33H, L33F, I36V, T37A, S48C, S39I, E44D, N45S, D46E, T47A, E58G, E59G, K65R, S67L, H69L, P71S, Q72H, V73A, Q74R, R76G, D77N, Q82R, I85F, I86T, V89D, W91R, or a conservative amino acid substitution thereof.

12. The variant PD-L2 polypeptide of any of embodiments 1-11, wherein the one or more amino acid modifications are selected from among H15Q, N24D, E44D, V89D, Q82R/V89D,
E59G/Q82R, S39I/V89D, S67L/V89D, S67L/I85F, S67L/I86T, H15Q/K65R, H15Q/Q72H/V89D, H15Q/S67L/R76G, H15Q/R76G/I85F, H15Q/T47A/Q82R, H15Q/Q82R/V89D, H15Q/C23S/I86T, H15Q/S39I/I86T, E44D/V89D/W91R, I13V/S67L/V89D, H15Q/S67L/I86T, I13V/H15Q/S67L/I86T, I13V/H15Q/E44D/V89D, I13V/S39I/E44D/Q82R/V89D, I13V/E44D/Q82R/V89D, I13V/Q72H/R76G/I86T, I13V/H15Q/R76G/I85F, H15Q/S39I/R76G/V89D, H15Q/S67L/R76G/I85F, H15Q/T47A/Q72H/R76G/I86T, H15Q/T47A/Q72H/R76G, I13V/H15Q/T47A/Q72H/R76G, H15Q/E44D/R76G/I85F, H15Q/S39I/S67L/V89D, H15Q/N32D/S67L/V89D, N32D/S67L/V89D, H15Q/S67L/Q72H/R76G/V89D, H15Q/Q72H/Q74R/R76G/I86T, G28V/Q72H/R76G/I86T, I13V/H15Q/S39I/E44D/S67L, E44D/S67L/Q72H/Q82R/V89D, H15Q/V89D, H15Q/T47A, I13V/H15Q/Q82R, I13V/H15Q/V89D, I13V/S67L/Q82R/V89D, I13V/H15Q/Q82R/V89D, H15Q/V31M/S67L/Q82R/V89D, I13V/H15Q/T47A/Q82R, I13V/H15Q/V31A/N45S/Q82R/V89D, H15Q/T47A/H69L/Q82R/V89D, I13V/H15Q/T47A/H69L/R76G/V89D, I12V/I13V/H15Q/T47A/Q82R/V89D, I13V/H15Q/R76G/D77N/Q82R/V89D, I13V/H15Q/T47A/R76G/V89D, I13V/H15Q/T47A/Q82R/V89D, I13V/H15Q/N24D/Q82R/V89D, I13V/H15Q/I36V/T47A/S67L/V89D, H15Q/T47A/K65R/S67L/Q82R/V89D, H15Q/L33P/T47A/S67L/P71S/V89D, I13V/H15Q/Q72H/R76G/I86T, H15Q/T47A/S67L/Q82R/V89D, F2L/H15Q/D46E/T47A/Q72H/R76G/Q82R/V89D, I13V/H15Q/L33F/T47A/Q82R/V89D, I13V/H15Q/T47A/E58G/S67L/Q82R/V89D, H15Q/N24S/T47A/Q72H/R76G/V89D, I13V/H15Q/E44V/T47A/Q82R/V89D, H15Q/N18D/T47A/Q72H/V73A/R76G/I86T/V89D, I13V/H15Q/T37A/E44D/S48C/S67L/Q82R/V89D, H15Q/L33H/S67L/R76G/Q82R/V89D, I13V/H15Q/T47A/Q72H/R76G/I86T, H15Q/S39I/E44D/Q72H/V75G/R76G/Q82R/V89D, H15Q/T47A/S67L/R76G/Q82R/V89D, or I13V/H15Q/T47A/S67L/Q72H/R76G/Q82R/V89D.

13. The variant PD-L2 polypeptide of any of embodiments 1-12, wherein the one or more amino acid substitutions correspond to position(s) selected from 13, 15, 39, 44, 47 67, 72, 76, 82, 85, 86, or 89, optionally wherein the one or more amino acid substitutions are selected from I13V, H15Q, E44D, T47A, S67L, Q72H, R76G, Q82R, I85F, I86T, V89D, or a conservative amino acid substitution thereof.

14. The variant PD-L2 polypeptide of any of embodiments 1-13, wherein the one or more amino acid substitutions correspond to position(s) selected from 13, 15, 44, 47, 67, 72, 76, 82, 86, or 89, optionally wherein the one or more amino acid substitutions are selected from I13V, H15Q, E44D, T47A, S67L, Q72H, R76G, Q82R, I86T, V89D, or a conservative amino acid substitution thereof.

15. The variant PD-L2 polypeptide of any of embodiments 1-14, wherein the variant PD-L2 polypeptide comprises amino acid modifications I13V/H15Q, I13V/T47A, I13V/S67L, I13V/Q72H, I13V/Q72H, I13V/R76G, I13V/Q82R, I13V/I86T, I13V/V89D, H15Q/T47A, H15Q/S67L, H15Q/Q72H, H15Q/Q72H, H15Q/R76G, H15Q/Q82R, H15Q/I86T, H15Q/V89D, T47A/S67L, T47A/Q72H, T47A/Q72H, T47A/R76G, T47A/Q82R, T47A/I86T, T47A/V89D, S67L/Q72H, S67L/Q72H, S67L/R76G, S67L/Q82R, S67L/I86T, S67L/V89D, Q72H/R76G, Q72H/Q82R, Q72H/I86T, Q72H/V89D, R76G/Q82R, R76G/I86T, R76G/V89D, Q82R/I86T, Q82R/V89D or I86T/V89D.

16. The variant PD-L2 polypeptide of any of embodiments 1-11, wherein the variant PD-L2 polypeptide comprises amino acid modifications H15Q/S62L/Q82R, H15Q/S62L/V89D, H15Q/Q82R/V89D, or S62L/Q82R/V89D.

17. The variant PD-L2 polypeptide of any of embodiments 1-16, wherein the variant PD-L2 polypeptide comprises amino acid modifications H15Q/T47A/K65R/S67L/Q82R/V89D.

18. The variant PD-L2 polypeptide of any of embodiments 1-17, wherein the variant PD-L2 polypeptide comprises or consists of the IgV domain or a specific fragment thereof and the IgC domain or a specific fragment thereof.

19. The variant PD-L2 polypeptide of any of embodiments 1-18, comprising or consisting of the sequence of amino acids set forth in any of SEQ ID NOS: 56-106, 108-114, 116-132 or a specific binding fragment thereof, or a sequence of amino acids that exhibits at least 95% sequence identity to any of SEQ ID NOS: 56-106, 108-114, 116-132 or a specific binding fragment thereof and that contains the one or more of the amino acid substitutions thereof.

20. The variant PD-L2 polypeptide of any of embodiments 1-17, wherein the variant PD-L2 polypeptide comprises or consists of the IgV domain or a specific binding fragment thereof.

21. The variant PD-L2 polypeptide of any of embodiments 1-17 and 20, wherein the IgV domain or specific binding fragment thereof is the only PD-L2 portion of the variant PD-L2 polypeptide.

22. The variant PD-L2 polypeptide of any of embodiments 1-21, comprising or consisting of the sequence of amino acids set forth in any of SEQ ID NOS: 133-183, 185-191, 193-209, 268-318, 320-343 or a specific binding fragment thereof, or a sequence of amino acids that exhibits at least 95% sequence identity to any of SEQ ID NOS: 133-183, 185-191, 193-209, 268-318, 320-343 or a specific binding fragment thereof and that comprises the one or more of the amino acid modifications thereof.

23. The variant PD-L2 polypeptide of any of embodiments 1-17, wherein the IgC domain or specific binding fragment thereof is the only PD-L2 portion of the variant PD-L2 polypeptide.

24. The variant PD-L2 polypeptide of any of embodiments 1-23, wherein the variant PD-L2 polypeptide specifically binds to the ectodomain of PD-1 or RGMb with increased affinity compared to the binding of the unmodified PD-L2 to the ectodomain of PD-1 or RGMb.

25. The variant PD-L2 polypeptide of any of embodiments 1-24, wherein the variant PD-L2 polypeptide specifically binds to the ectodomain of PD-1 with increased affinity compared to the binding of the unmodified PD-L2 to the ectodomain of PD-1.

26. The variant PD-L2 polypeptide of any of embodiments 1-25, wherein the variant PD-L2 polypeptide specifically binds to the ectodomain of PD-1 and the ectodomain of RGMb each with increased affinity compared to the binding of the unmodified PD-L2 to the ectodomain of PD-1 and the ectodomain of RGMb.

27. The variant PD-L2 polypeptide of any of embodiments 1-26, wherein the variant PD-L2 polypeptide specifically binds to the ectodomain of PD-1 with increased affinity and specifically binds to the ectodomain of the other of RGMb with decreased affinity compared to the binding of the unmodified PD-L2 to the ectodomain of the other of RGMb.

28. The variant PD-L2 polypeptide of any of embodiments 24-27, wherein the increased affinity to the ectodomain of PD-1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the unmodified PD-L2.

29. The variant PD-L2 polypeptide of embodiment 24 or embodiment 26, wherein the increased affinity to the ectodomain of RGMb is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the unmodified PD-L2.

30. The variant PD-L2 polypeptide of embodiment 27, wherein the decreased affinity to the ectodomain of RGMb is decreased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold compared to the unmodified PD-L2.

31. The variant PD-L2 polypeptide of any of embodiments 1-30, wherein the variant polypeptide specifically binds to the ectodomain of PD-1 with increased selectivity compared to the unmodified PD-L2.

32. The variant PD-L2 polypeptide of embodiment 31, wherein the increased selectivity comprises a greater ratio of binding of the variant polypeptide for PD-1 versus RGMb compared to the ratio of binding of the unmodified PD-L2 polypeptide for PD-1 versus RGMb.

33. The variant PD-L2 polypeptide of embodiment 32, wherein the ratio is greater by at least or at least about 1.5-fold, 2.0-fold, 3.0-fold, 4.0-fold, 5.0-fold, 10-fold, 15-fold, 20-fold, 30-fold, 40-fold, 50-fold or more.

34. The variant PD-L2 polypeptide of any of embodiments 9-33, wherein the PD-1 is a human PD-1.

35. The variant PD-L2 polypeptide of any of embodiments 9-34, wherein the RGMb is a human RGMb.

36. The variant PD-L2 polypeptide of any of embodiments 1-35, wherein the binding activity is altered (increased or decreased) more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold compared to the unmodified PD-L2.

37. The variant PD-L2 polypeptide of any of embodiments 1-34 that is a soluble protein.

38. The variant PD-L2 polypeptide of any of embodiments 1-37, wherein:

the variant PD-L2 polypeptide lacks the PD-L2 transmembrane domain and intracellular signaling domain; and/or the variant PD-L2 polypeptide is not capable of being expressed on the surface of a cell.

39. The variant PD-L2 polypeptide of any of embodiments 1-38, wherein the variant PD-L2 polypeptide is linked to a moiety that increases biological half-life of the polypeptide.

40. The variant PD-L2 polypeptide of any of embodiments 1-39, wherein the variant PD-L2 polypeptide is linked to a multimerization domain. 41. The variant PD-L2 polypeptide of embodiment 40, wherein the variant PD-L2 polypeptide is linked to an Fc domain or a variant Fc domain with reduced effector function.

42. The variant PD-L2 polypeptide of any of embodiments 39-41, wherein:

the Fc domain is mammalian, optionally human; or the variant Fc domain comprises one or more amino acid modifications compared to an unmodified Fc domain that is mammalian, optionally human.

43. The variant PD-L2 polypeptide of any one of embodiments 41 and embodiment 42, wherein the Fc domain or variant thereof comprises the sequence of amino acids set forth in SEQ ID NO:211 or SEQ ID NO:212 or a sequence of amino acids that exhibits at least 85% sequence identity to SEQ ID NO:211 or SEQ ID NO:212.

44. The variant PD-L2 polypeptide of any of embodiments 41-43, wherein the Fc domain comprises one or more amino acid modifications selected from among E233P, L234A, L234V, L235A, L235E, G236del, G237A, S267K, N297G, V302C, and K447del each by EU numbering.

45. The variant PD-L2 polypeptide of any of embodiments 40-44, wherein the Fc domain comprises the amino acid modification C220S by EU numbering.

46. The variant PD-L2 polypeptide of any of embodiments 40-45, wherein the Fc domain comprises the sequence of amino acids set forth in any of SEQ ID NOS: 1189, 1205, 1206, 1207, 1739, 1738, 1739, 1740 or a sequence of amino acids that exhibits at least 85% sequence identity to any of SEQ ID NOS: 1189, 1205, 1206, 1207, 1739, 1738, 1739, 1740 and exhibits reduced effector function.

47. The variant PD-L2 polypeptide of any of embodiments 41-46, wherein the variant PD-L2 polypeptide is linked indirectly via a linker, optionally a G4S linker.

48. The variant PD-L2 polypeptide of any of embodiments 1-47, wherein the variant PD-L2 polypeptide is a transmembrane immunomodulatory protein further comprising a transmembrane domain, optionally wherein the transmembrane domain is linked, directly or indirectly, to the extracellular domain (ECD) or specific binding fragment thereof of the variant PD-L2 polypeptide.

49. The variant PD-L2 polypeptide of embodiment 48, wherein the transmembrane domain comprises the sequence of amino acids set forth as residues 221-241 of SEQ ID NO:4 or a functional variant thereof that exhibits at least 85% sequence identity to residues 221-241 of SEQ ID NO:4.

50. The variant PD-L2 polypeptide of embodiment 48 or embodiment 49, further comprising a cytoplasmic signaling domain, optionally wherein the cytoplasmic domain is linked, directly or indirectly, to the transmembrane domain.

51. The variant PD-L2 polypeptide of embodiment 50, wherein the cytoplasmic signaling domain comprises the sequence of amino acids set forth as residues 242-273 of SEQ ID NO:4 or a functional variant thereof that exhibits at least 85% sequence identity to residues 242-273 of SEQ ID NO:4.

52. The variant PD-L2 polypeptide of any of embodiments 1-51, wherein the variant PD-L2 increases IFN-gamma (interferon-gamma) expression relative to the unmodified PD-L2 in an in vitro T-cell assay.

53. The variant PD-L2 polypeptide of any of embodiments 1-51, wherein the variant PD-L2 decreases IFN-gamma (interferon-gamma) expression relative to the unmodified PD-L2 in an in vitro T-cell assay.

54. The variant PD-L2 polypeptide of any of embodiments 1-53 that is deglycosylated.

55. An immunomodulatory protein, comprising the variant PD-L2 polypeptide of any of embodiments 1-54 linked, directly or indirectly via a linker, to a second polypeptide comprising an immunoglobulin superfamily (IgSF) domain of an IgSF family member.

56. The immunomodulatory protein of embodiment 55, wherein the IgSF domain is an affinity-modified IgSF domain, said affinity-modified IgSF domain comprising one or more amino acid modifications compared to the unmodified or wild-type IgSF domain of the IgSF family member.

57. The immunomodulatory protein of embodiment 56, wherein the affinity modified IgSF domain exhibits altered binding to one or more of its cognate binding partner(s) compared to the binding of the unmodified or wild-type IgSF domain of the IgSF family member to the same one or more cognate binding partner(s).

58. The immunomodulatory protein of embodiment 57, wherein the IgSF domain exhibits increased binding to one or more of its cognate binding partner(s) compared to the binding of the unmodified or wild-type IgSF domain to the same one or more cognate binding partner(s).

59. The immunomodulatory polypeptide of any one of embodiments 56-58, wherein the variant PD-L2 is a first PD-L2 variant and the IgSF domain of the second polypeptide is an IgSF domain from a second variant PD-L2 of any of embodiments 1-58, wherein the first and second PD-L2 variant are the same or different.

60. The immunomodulatory protein of any one of embodiments 55-59, wherein the variant PD-L2 polypeptide is capable of specifically binding to PD-1 or RGMb and the IgSF domain of the second polypeptide is capable of binding to a cognate binding partner other than one specifically bound by the PD-L2 variant polypeptide.

61. The immunomodulatory protein of any of embodiments 55-60, wherein the IgSF domain is from a member of the B7 family.

62. The immunomodulatory protein of any of embodiments 55-60, wherein the IgSF domain is a tumor-localizing moiety that binds to a ligand expressed on a tumor or is an inflammatory-localizing moiety that binds to a ligand expressed on a cell or tissue of an inflammatory environment.

63. The immunomodulatory protein of embodiment 62, wherein the ligand is B7H6.

64. The immunomodulatory protein of embodiment 62 or embodiment 63, wherein the IgSF domain is from NKp30.

65. The immunomodulatory protein of any of embodiments 55-64, wherein the IgSF domain or affinity-modified IgSF domain thereof, optionally of the second or third polypeptide, is or comprises an IgV domain.

66. The immunomodulatory protein of any of embodiments 55-65, wherein the variant PD-L2 polypeptide is or comprises an IgV domain.

67. The immunomodulatory protein of any of embodiments 55-66, wherein the immunomodulatory protein further comprises a multimerization domain linked to at least one of the variant PD-L2 polypeptide or the second polypeptide, optionally wherein the multimerization domain is an Fc domain or a variant thereof with reduced effector function.

68. The immunomodulatory protein of any embodiments 55-67, wherein the IgSF domain of the second polypeptide is an IgSF domain of a ligand that binds to an inhibitory receptor, or is an affinity-modified IgSF domain thereof, optionally wherein the affinity-modified IgSF domain exhibits increased binding affinity and/or binding selectivity for the inhibitory receptor compared to binding of the unmodified IgSF domain to the same inhibitory receptor.

69. The immunomodulatory protein of embodiment 68, wherein:
the inhibitory receptor is TIGIT or CTLA-4; or
the ligand of the inhibitory receptor is CD155, CD112, or CD80.

70. The immunomodulatory protein of any of embodiments 55-69, wherein the second polypeptide is selected from:
(i) a wildtype CD155 comprising an IgSF set forth in any of SEQ ID NOS: 47, 344, or 387, or a variant CD155 polypeptide comprising an IgSF domain set forth in any of SEQ ID NOS: 345-386, 388-699, 1527-1736;
(ii) a wildtype CD112 comprising an IgSF domain set forth in any of SEQ ID NOS: 48, 700, or 795, or a variant CD112 polypeptide comprising an IgSF domain set forth in any of SEQ ID NOS: 701-794, 796-965, 1455-1526;
(iii) a wildtype CD80 comprising an IgSF set forth in any of SEQ ID NOS:28, 1039, or 2039, or a variant CD80 polypeptide comprising an IgSF domain set forth in any of SEQ ID NOS: 966-998, 1000-1038, 1040-1072, 1074-1112, 1114-1146, 1147-1186;
(iv) a wildtype PD-L1 comprising an IgSF set forth in any of SEQ ID NOS: 30, 1812, 1258, or 1454, or a variant PD-L1 polypeptide comprising an IgSF domain set forth in any of SEQ ID NOS:1259-1453, 1743-1811, 1813-2021;
(v) a sequence of amino acids that exhibits at least 95% sequence identity to any of the SEQ ID NOS in (i)-(iv) and that comprises the amino acid modifications, optionally amino acid substitutions, insertions and/or deletions thereof; or
(vi) a specific binding fragment of any of (i)-(v).

71. The immunomodulatory protein of any of embodiments 55-70, further comprising a third polypeptide comprising a wild-type IgSF domain or a variant or affinity-modified IgSF domain thereof, said affinity-modified IgSF domain comprising one or more amino acid modifications compared to the unmodified or wild-type IgSF domain of the IgSF family member, wherein:
the third polypeptide is the same as the first and/or second polypeptide; or
the third polypeptide is different from the first and/or second polypeptide.

72. The immunomodulatory protein of embodiment 71, wherein the IgSF domain of the third polypeptide is an affinity-modified IgSF domain comprising:
(i) a wildtype CD155 comprising an IgSF set forth in any of SEQ ID NOS: 47, 344, or 387, or a variant CD155 polypeptide comprising an IgSF domain set forth in any of SEQ ID NOS: 345-386, 388-699, 1527-1736;
(ii) a wildtype CD112 comprising an IgSF domain set forth in any of SEQ ID NOS: 48, 700, or 795, or a variant CD112 polypeptide comprising an IgSF domain set forth in any of SEQ ID NOS: 701-794, 796-965, 1455-1526;
(iii) a wildtype CD80 comprising an IgSF set forth in any of SEQ ID NOS:28, 1039, or 2039, or a variant CD80 polypeptide comprising an IgSF domain set forth in any of SEQ ID NOS: 966-998, 1000-1038, 1040-1072, 1074-1112, 1114-1146, 1147-1186;
(iv) a wildtype PD-L1 comprising an IgSF set forth in any of SEQ ID NOS: 30, 1812, 1258, or 1454, or a variant PD-L1 polypeptide comprising an IgSF domain set forth in any of SEQ ID NOS:1259-1453, 1743-1811, 1813-2021;
(v) a sequence of amino acids that exhibits at least 95% sequence identity to any of the SEQ ID NOS in (i)-(iv) and that comprises the amino acid modifications, optionally amino acid substitutions, insertions and/or deletions thereof; or (vi) a specific binding fragment of any of (i)-(v).

73. The immunomodulatory protein of 70-72, further comprising at least one additional polypeptide comprising an IgSF domain of an IgSF family member or an affinity-modified IgSF domain thereof, said affinity-modified IgSF domain comprising one or more amino acid modifications compared to the binding of the unmodified or wild-type IgSF domain of the IgSF family member.

74. The immunomodulatory protein of any of embodiments 71-73, wherein the immunomodulatory protein further comprises a multimerization domain linked to at least one of the variant PD-L2 polypeptide, the second polypeptide and/or the third polypeptide, optionally wherein the multimerization domain is an Fc domain or a variant thereof with reduced effector function.

75. The immunomodulatory protein of any of embodiments 67-74, wherein the multimerization domain promotes heterodimer formation.

76. An immunomodulatory protein comprising a first variant PD-L2 polypeptide of any of embodiments 40-47 in which the multimerization domain is a first multimerization domain and a second variant PD-L2 polypeptide of any of embodiments 40-47 in which the multimerization domain is a second multimerization domain, wherein the first and second multimerization domains interact to form a multimer comprising the first and second variant PD-L2 polypeptide, optionally wherein the first and second variant PD-L2 polypeptides are the same.

77. An immunomodulatory protein comprising the immunomodulatory protein of any of embodiments 67-75, wherein the multimerization domain is a first multimerization domain and interacts with a second multimerization domain to form a multimer comprising the immunomodulatory protein.

78. The immunomodulatory protein of embodiment 77, wherein the immunomodulatory protein is a first immunomodulatory protein and a second immunomodulatory protein is linked directly or indirectly via a linker to the second multimerization domain, wherein the multimer comprises the first and second immunomodulatory protein.

79. The immunomodulatory protein of embodiment 78, wherein the second immunomodulatory protein is an immunomodulatory protein of any of caims 67-75, wherein the multimerization domain is the second multimerization domain.

80. The immunomodulatory protein of any of embodiments 76-79, wherein the multimer is a dimer.

81. The immunomodulatory protein of any of embodiments 76-80 that is a homodimer, optionally wherein the first and second multimerization domain is the same.

82. The immunomodulatory protein of any of embodiments 77-81, wherein the second polypeptide is a variant CD155 polypeptide and the first and/or second immunomodulatory protein comprises the sequence set forth in any of SEQ ID NOS: 1191-1196, or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 1191-1196.

83. The immunomodulatory protein of any of embodiments 76-80 that is a heterodimer, optionally wherein the first and second multimerization domain are different and/or are capable of interacting to mediate heterodimer formation.

84. The immunomodulatory protein of any of embodiments 77-80 and 83, wherein the second polypeptide is a variant CD155 polypeptide and:

the first or second immunomodulatory protein comprises the sequence set forth in any of SEQ ID NOS: 1197, 1198, 1199, 1200, 1201, 1203 or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 1197, 1198, 1199, 1200, 1201 or 1203; and the other of the first or second immunomodulatory protein comprises the sequence set forth in any of SEQ ID NOS: 1188, 1190, 1202 or 1204, or a sequence of amino acids that exhibits at least 85%, 86%, 87%, 88%, 89%, 90%, 91%, 92%, 93%, 94%, 95%, 96%, 97%, 98% or 99% sequence identity to any of SEQ ID NOS: 1188, 1190, 1202 or 1204.

85. The immunomodulatory protein of any of embodiments 76-84, wherein the first and/or second multimerization domain is an Fc domain or a variant thereof with reduced effector function, optionally wherein:

the Fc domain is of an immunoglobulin protein that is human and/or the Fc region is human, optionally wherein the Fc region is of an immunoglobulin G1 (IgG1) or an immunoglobulin G2 (IgG2), optionally set forth in SEQ ID NO:211 or SEQ ID NO:212; or the variant Fc domain comprises one or more amino acid substitutions in a wild-type Fc region, optionally wherein the reduced effector function is reduced compared to a wildtype Fc region, optionally wherein the wildtype human Fc is of human IgG1.

86. The immunomodulatory protein of any of embodiments 76-85, wherein the first and second multimerization domain is the same or different.

87. The immunomodulatory protein of any of embodiments 65-75, 85 and 86, wherein the variant Fc region comprises:

the amino acid substitutions E233P, L234A, L234V, L235A, L235E, G236del, G237A, S267K, or N297G, with residue numbering according to the EU index of Kabat; or the amino acid substitutions R292C/N297G/V302C or L234A/L235E/G237A, with residue numbering according to the EU index of Kabat.

88. The immunomodulatory protein of any of embodiments 65-75 and 85-87, wherein the Fc region or variant Fc region comprises the amino acid substitution C220S, with residue numbering according to the EU index of Kabat.

89. The immunomodulatory protein of any of embodiments 65-75 and 85-88, wherein the Fc region or variant Fc region comprises K447del, with residue numbering according to the EU index of Kabat.

90. A conjugate, comprising a variant PD-L2 of any of embodiments 1-54 or an immunomodulatory protein of any of embodiments 55-89 linked to a moiety.

91. The conjugate of embodiment 90, wherein the moiety is a targeting moiety that specifically binds to a molecule on the surface of a cell.

92. The conjugate of embodiment 91, wherein the targeting moiety specifically binds to a molecule on the surface of an immune cell, optionally wherein the immune cell is an antigen presenting cell or a lymphocyte.

93. The conjugate of embodiment 91, wherein the targeting moiety is a tumor-localizing moiety that binds to a molecule on the surface of a tumor.

94. The conjugate of any of embodiments 90-93, wherein the moiety is a protein, a peptide, nucleic acid, small molecule or nanoparticle.

95. The conjugate of any of embodiments 90-94, wherein the moiety is an antibody or antigen-binding fragment.

96. The conjugate of any of embodiments 90-95, wherein the conjugate is divalent, tetravalent, hexavalent or octavalent.

97. The conjugate of any of embodiments 90-96 that is a fusion protein.

98. A nucleic acid molecule(s), encoding a variant PD-L2 polypeptide of any of embodiments 1-59, an immunomodulatory protein of any of embodiments 55-89 or a conjugate that is a fusion protein of any of embodiments 90-97.

99. The nucleic acid molecule of embodiment 98 that is a synthetic nucleic acid.

100. The nucleic acid molecule of embodiment 98 or embodiment 99 that is cDNA.

101. A vector, comprising the nucleic acid molecule of any of embodiments 98-100.

102. The vector of embodiment 101 that is an expression vector.

103. The vector of embodiment 101 or embodiment 102, wherein the vector is a mammalian expression vector or a viral vector.

104. A cell, comprising the vector of any of embodiments 101-103.

105. The cell of embodiment 104 that is a mammalian cell.

106. The cell of embodiment 104 or embodiment 105 that is a human cell.

107. A method of producing a variant PD-L2 polypeptide or an immunomodulatory protein, comprising introducing the nucleic acid molecule of any of embodiments 98-100 or vector of any of embodiments 101-103 into a host cell under conditions to express the protein in the cell.

108. The method of embodiment 107, further comprising isolating or purifying the variant PD-L2 polypeptide or immunomodulatory protein from the cell.

109. A method of engineering a cell expressing a variant PD-L2 variant polypeptide, comprising introducing a nucleic acid molecule encoding the variant PD-L2 polypeptide of any of embodiments 1-54 into a host cell under conditions in which the polypeptide is expressed in the cell.

110. An engineered cell, expressing the variant PD-L2 polypeptide of any of embodiments 1-54, the immunomodulatory protein of any of embodiments 55-89, a conjugate that is a fusion protein of any of embodiments 90-97, the nucleic acid molecule of any of embodiments 98-100 or the vector of any of embodiments 101-102.

111. The engineered cell of embodiment 110, wherein the variant PD-L2 polypeptide or immunomodulatory protein is encoded by a nucleic acid comprising a sequence of nucleotides encoding a signal peptide.

112. The engineered cell of embodiment 110 or embodiment 111, wherein the variant PD-L2 polypeptide or immunomodulatory protein does not comprise a transmembrane domain and/or is not expressed on the surface of the cell.

113. The engineered cell of any of embodiments 110-112, wherein the variant PD-L2 polypeptide or immunomodulatory protein is secreted or is capable of being secreted from the engineered cell.

114. The engineered cell of embodiment 110 or embodiment 111, wherein the engineered cell comprises a variant PD-L2 polypeptide that comprises a transmembrane domain and/or is the transmembrane immunomodulatory protein of any of embodiments 48-54.

115. The engineered cell of embodiment 110, embodiment 111 or embodiment 114, wherein the variant PD-L2 polypeptide is expressed on the surface of the cell.

116. The engineered cell of any of embodiments 110-115, wherein the cell is an immune cell.

117. The engineered cell of embodiment 116, wherein the immune cell is an antigen presenting cell (APC) or a lymphocyte.

118. The engineered cell of any of embodiments 110-117, wherein the cell is a lymphocyte and the lymphocyte is a T cell.

119. The engineered cell of embodiment 118, wherein the cell is an APC and the APC is an artificial APC.

120. The engineered cell of any of embodiments 110-119 that is a primary cell.

121. The engineered cell of any of embodiments 110-120, wherein the cell is a mammalian cell.

122. The engineered cell of any of embodiments 110-121, wherein the cell is a human cell.

123. The engineered cell of any of embodiments 110-122, wherein the cell further comprises a chimeric antigen receptor (CAR) or an engineered T-cell receptor.

124. An infectious agent, comprising a nucleic acid molecule encoding a variant PD-L2 polypeptide of any of embodiments 1-54, an immunomodulatory polypeptide of any of embodiments 55-89 or a conjugate that is a fusion protein of any of claims 90-97.

125. The infectious agent of embodiment 124, wherein the encoded variant PD-L2 polypeptide or immunomodulatory polypeptide does not comprise a transmembrane domain and/or is not expressed on the surface of a cell in which it is expressed.

126. The infectious agent of embodiment 124 or embodiment 125, wherein the encoded variant PD-L2 polypeptide or immunomodulatory polypeptide is secreted or is capable of being secreted from a cell in which it is expressed.

127. The infectious agent of embodiment 124, wherein the encoded variant PD-L2 polypeptide comprises a transmembrane domain.

128. The infectious agent of embodiment 124 or embodiment 127, wherein the encoded variant PD-L2 polypeptide is expressed on the surface of a cell in which it is expressed.

129. The infectious agent of any of embodiments 124-128, wherein the infectious agent is a bacterium or a virus.

130. The infectious agent of embodiment 129, wherein the infectious agent is a virus and the virus is an oncolytic virus.

131. The infectious agent of embodiment 130, wherein the oncolytic virus is an adenovirus, adeno-associated virus, herpes virus, Herpes Simplex Virus, Vesticular Stomatic virus, Reovirus, Newcastle Disease virus, parvovirus, measles virus, vesticular stomatitis virus (VSV), Coxsackie virus or a Vaccinia virus.

132. The infectious agent of embodiment 130 or embodiment 131, wherein the virus specifically targets dendritic cells (DCs) and/or is dendritic cell-tropic.

133. The infectious agent of embodiment 132, wherein the virus is a lentiviral vector that is pseudotyped with a modified Sindbis virus envelope product.

134. The infectious agent of any of embodiments 124-133, further comprising a nucleic acid molecule encoding a further gene product that results in death of a target cell or that can augment or boost an immune response.

135. The infectious agent of embodiment 134, wherein the further gene product is selected from an anticancer agent, anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or a reprogramming human somatic cells to pluripotency.

136. A pharmaceutical composition, comprising the variant PD-L2 polypeptide of any of embodiments 1-54, an immunomodulatory protein of any of embodiments 55-89, a conjugate of any of embodiments 90-97 or an engineered cell of any of embodiments 110-123 or an infectious agent of any of embodiments 124-135.

137. The pharmaceutical composition of embodiment 136, comprising a pharmaceutically acceptable excipient.

138. The pharmaceutical composition of embodiment 136 or 137, wherein the pharmaceutical composition is sterile.

139. An article of manufacture comprising the pharmaceutical composition of any of embodiments 136-138 in a vial.

140. The article of manufacture of embodiment 139, wherein the vial is sealed. 141. A kit comprising the pharmaceutical composition of any of embodiments 136-138, and instructions for use.

142. A kit comprising the article of manufacture according to embodiment 139 and 140, and instructions for use.

143. A method of modulating an immune response in a subject, comprising administering the pharmaceutical composition of any of embodiments 136-138 to the subject.

144. A method of modulating an immune response in a subject, comprising administering the engineered cells of any of embodiments 110-123.

145. The method of embodiment 144, wherein the engineered cells are autologous to the subject.

146. The method of embodiment 144, wherein the engineered cells are allogenic to the subject.

147. The method of any of embodiments 143-146, wherein modulating the immune response treats a disease or condition in the subject.

148. The method of any of embodiments 143-147, wherein the immune response is increased.

149. The method of any of embodiments 143-148, wherein a variant PD-L2 polypeptide or immunomodulatory protein that is soluble, optionally that lacks a PD-L2 transmembrane and intracellular signaling domain, is administered to the subject.

150. The method of any of embodiments 143-149, wherein the variant polypeptide or immunomodulatory protein is an Fc fusion protein.

151. The method of any of embodiments 143 and 148-150, wherein a variant PD-L2 polypeptide of any of embodiments 1-54, or the immunomodulatory protein of any of embodiments 55-89 is administered to the subject.

152. The method of any of embodiments 143-149 wherein an engineered cell comprising a secretable variant PD-L2 polypeptide is administered to the subject.

153. The method of any of embodiments 143 and 148-152, wherein an engineered cell of any of embodiments 98-101 and 104-111 is administered to the subject.

154. The method of any of embodiments 143, 147 and 148, wherein an infectious agent encoding a variant PD-L2 polypeptide that is a secretable immunomodulatory protein is administered to the subject, optionally under conditions in which the infectious agent infects a tumor cell or immune cell and the secretable immunomodulatory protein is secreted from the infected cell.

155. The method of any of embodiments 143-154, wherein the disease or condition is a tumor or cancer.

156. The method of any one of embodiments 143-155, wherein the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

157. The method of any of embodiments 143-147, wherein the immune response is decreased.

158. The method of any of embodiments 143-147 and 157, wherein an immunomodulatory protein or conjugate comprising a variant PD-L2 polypeptide linked to an IgSF domain or a moiety that localizes to a cell or tissue of an inflammatory environment is administered to the subject.

159. The method of embodiment 158, wherein the binding molecule comprises an antibody or an antigen-binding fragment thereof or comprises a wild-type IgSF domain or variant thereof.

160. The method of any of embodiments 143-147 and 157-159, wherein the immunomodulatory protein of any of embodiments 57-77 or the conjugate of any of embodiments 90-97 is administered to the subject.

161. The method of any of embodiments 143-147 and 157, wherein a variant PD-L2 polypeptide that is a transmembrane immunomodulatory protein is administered to the subject.

162. The method of any of embodiments 144-147 and 157-161, wherein the engineered cell comprising a variant PD-L2 polypeptide that is a transmembrane immunomodulatory protein of any of embodiments 50-59 is administered to the subject.

163. The method of any of embodiments 143, 147 and 157, wherein an infectious agent encoding a variant PD-L2 polypeptide that is a transmembrane immunomodulatory protein is administered to the subject, optionally under conditions in which the infectious agent infects a tumor cell or immune cell and the transmembrane immunomodulatory protein is expressed on the surface of the infected cell.

164. The method of any of embodiments 143-147 and 157-163, wherein the disease or condition is an inflammatory or autoimmune disease or condition.

165. The method of any of embodiments 143-147 and 157-164 wherein the disease or condition is an Antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

166. The method of embodiment 164 or embodiment 165, wherein the disease or condition is selected from inflammatory bowel disease, transplant, Crohn's disease, ulcerative colitis, multiple sclerosis, asthma, rheumatoid arthritis, or psoriasis.

IX. EXAMPLES

The following examples are included for illustrative purposes only and are not intended to limit the scope of the invention.

Example 1

Generation of Mutant DNA Constructs of IgSF Domains

Example 1 describes the generation of mutant DNA constructs of human PD-L2 IgSF domains for translation and expression on the surface of yeast as yeast display libraries.

A. Degenerate Libraries

Constructs were generated based on a wildtype human PD-L2 sequence set forth in SEQ ID NO:115 containing the immunoglobulin-like V-type (IgV) domain as follows:

LFTVTVPKELYIIEHGSNVTLECNFDTGSHVNLGAI-TASLQKVENDTSPHRERATLLEE QLPLGKASFHIPQVQVRDEGQYQCI-IYGVAWDYKYLTLKVKA (SEQ ID NO:115)

For libraries that target specific residues for complete or partial randomization with degenerate codons, degenerate codons, such as specific mixed base sets to code for various amino acid substitutions, are generated using an algorithm at the URL:rosettadesign.med.unc.edu/SwiftLib/. In general, positions to mutate were chosen from direct crystal structure information for PDL2::PD1 complex (e.g. PDB: 3BP5). Alternatively, a homology model may be generated if structures of homologous protein complexes are unavailable. Using the structural information, a structure viewer (available at the URL: spdbv.vital-it.ch) can be used to identify contact or non-contact interface residues for mutagenesis with degenerate codons The next step in library design can be the alignment of human, mouse, rat, and monkey PD-L2 sequences to identify which of the residues chosen for mutagenesis are conserved residues. Based on this analysis, conserved target residues can be mutated with degenerate codons that only specify conservative amino acid changes plus the wild-type residue. Residues that are not conserved can be mutated more aggressively, but also included the wild-type residue. Degenerate codons that also encoded the wild-type residue are deployed to avoid excessive mutagenesis of target protein. For the same reason, only up to 20 positions are targeted for mutagenesis for each library. Selection of residues for mutagenesis is focused on contact, such as target side chain residues that interact with the ligand, and non-contact interfacial residues that are within 6 Å of the binding surface with their side chains directed toward the ligand/counter structure.

To generate DNA encoding the targeted library, overlapping oligos of up to 80 nucleotides in length and containing degenerate codons at the residue positions targeted for mutagenesis, can be ordered from Integrated DNA Technologies (Coralville, USA). The oligonucleotides are dissolved in sterile water, mixed in equimolar ratios, heated to 95° C. for five minutes and slowly cooled to room temperature for annealing. IgV domain-specific oligonucleotide primers that anneal to the start and end of the IgV domain gene sequence are then used to generate a first PCR product. IgV domain-specific oligonucleotides which overlap by 40 bp with pBYDS03 cloning vector (Life Technologies USA), beyond and including the BamHI and KpnI cloning sites, are then used to amplify 10Ong of PCR product from the prior step to generate a total of at least 12 μg of DNA for every electroporation. Both PCR's were by polymerase chain reaction (PCR) using OneTaq 2× PCR Master Mix (New England Biolabs, USA). The second PCR products are purified using a PCR purification kit (Qiagen, Germany) and resuspended in sterile deionized water. Alternatively, Ultramers (Integrated DNA Technologies) of up to 200 bp in length can be used in conjunction with megaprimer PCR (www.ncbi.nlm.nih.gov/pmc/articles/PMC146891/pdf/253371.pdf) to generate larger stretches of degenerate codons that could not be as easily generated using multiple small overlapping primers. Following the generation of full length product using megaprimer PCR, the mutant IgV domain library is PCR amplified again using DNA primers containing 40 bp overlap region with the pBYDS03 cloning vector for homologous recombination into yeast.

To prepare for library insertion, pBYDS03 vector is digested with BamHI and KpnI restriction enzymes (New England Biolabs, USA) and the large vector fragment is gel-purified and dissolved in sterile, deionized water. Electroporation-ready DNA for the next step is generated by mixing 12 μg of library DNA insert with 4 μg of linearized vector in a total volume of 50 μL deionized and sterile water. An alternative method to generate targeted libraries, is to carry out site-directed mutagenesis (Multisite kit, Agilent, USA) of the target IgV domain with oligonucleotides containing degenerate codons. This approach can be used to generate sublibraries that only target a few specific stretches of DNA for mutagenesis. In these cases, sublibraries can be mixed before proceeding to the selection steps. In general, library sizes are in the range of 10E7 to 10E8 clones, except that sublibraries are only in the range of 10E4 to 10E5.

B. Random Libraries

Random libraries were also constructed to identify variants of the IgV domain of PD-L2 set forth in SEQ ID NO:115. DNA encoding the wild-type IgV domain was cloned between the BamHI and KpnI sites of the yeast display vector pBYDS03. The DNA was then mutagenized with the Genemorph II Kit (Agilent, USA) to generate an average of three to five amino acid changes per library variant. Mutagenized DNA was then amplified by the two-step PCR and further processed as described above for targeted libraries.

Example 2

Introduction of DNA Libraries into Yeast

Example 2 describes the introduction of PD-L2 DNA libraries into yeast.

To introduce library DNA into yeast, electroporation-competent cells of yeast strain BJ5464 (ATCC.org; ATCC number 208288) were prepared and electroporated on a Gene Pulser II (Biorad, USA) with the electroporation-ready DNA from the steps above essentially as described (Colby, D. W. et al. 2004 Methods Enzymology 388, 348-358). The only exception is that transformed cells were grown in non-inducing minimal selective SCD-Leu medium to accommodate the LEU2 selectable marker carried by modified plasmid pBYDS03. One liter of SCD-Leu media consists of 14.7 grams sodium citrate, 4.29 grams citric acid monohydrate, 20 grams dextrose, 6.7 grams yeast nitrogen base, and 1.6 grams yeast synthetic drop-out media supplement without leucine. The Medium was filter sterilized before use using a 0.22 vacuum filter device.

Library size was determined by plating serial dilutions of freshly recovered cells on SCD-Leu agar plates and then extrapolating library size from the number of single colonies from plating that generated at least 50 colonies per plate. In general, library sizes ranged from 10E8 to 10E9 transformants based on this dilution assay. The remainder of the electroporated culture was grown to saturation in SCD-Leu and cells from this culture were subcultured 1/100 into fresh SCD-Leu once more and grown to saturation to minimize the fraction of untransformed cells, and grown overnight and to allow for segregation of plasmid from cells that may contain two or more library variants. To maintain library diversity, this subculturing step was carried out using an inoculum that contained at least 10× more cells than the calculated library size. Cells from the second saturated culture were resuspended in fresh medium containing sterile 25% (weight/volume) glycerol to a density of 10E10/mL and frozen and stored at −80° C. (frozen library stock).

Example 3

Yeast Selection

Example 3 describes the selection of yeast expressing affinity modified variants of PD-L2.

A number of cells equal to at least 10 times the estimated library size were thawed from individual library stocks, suspended to 0.1×10E6 cells/mL in non-inducing SCD-Leu medium, and grown overnight. The next day, a number of cells equal to 10 times the library size were centrifuged at 2000 RPM for two minutes and resuspended to 0.5×10E6 cells/mL in inducing SCDG-Leu media. One liter of the SCDG-Leu induction media consists of 5.4 grams $Na_2HPO_4$, 8.56 grams of $NaH_2PO_4·H_2O$, 20 grams galactose, 2.0 grams dextrose, 6.7 grams yeast nitrogen base, and 1.6 grams of yeast synthetic drop out media supplement without leucine dissolved in water and sterilized through a 0.22 µm membrane filter device. The culture was grown in induction medium for 1 day at room temperature to induce expression of library proteins on the yeast cell surface.

Cells were sorted two to three times using magnetic beads loaded with cognate ligand to reduce non-binders and enrich for all variant PD-L2 with the ability to bind their exogenous recombinant counter-structure proteins. This was then followed by one to two rounds of fluorescence activated cell sorting (FACS) using decreasing concentrations of exogenous counter-structure protein staining in each round to enrich the fraction of yeast cells that displays improved binders. Magnetic bead enrichment and selections by flow cytometry were carried out essentially as described in Miller, K. D. et al., Current Protocols in Cytometry 4.7.1-4.7.30, July 2008.

With PD-L2 libraries, target ligand proteins was rhPD-1.Fc (i.e., recombinant human PD-1-Fc fusion protein from R&D Systems, USA). Magnetic Protein A beads were obtained from New England Biolabs, USA. For two-color, flow cytometric sorting, a Bio-Rad S3e sorter was used. PD-L2 display levels were monitored with an anti-hemagglutinin antibody labeled with Alexafluor 488 (Life Technologies, USA). Ligand binding of Fc fusion proteins to rhPD-1.Fc was detected with rPhycoerythrin (PE) conjugated anti-human Ig specific goat Fab (Jackson ImmunoResearch, USA). Doublet yeast were gated out using forward scatter (FSC)/side scatter (SSC) parameters, and sort gates were based upon higher ligand binding detected in FL2 that possessed more limited tag expression binding in FL1.

Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

For PD-L2, the second round FACS outputs (F2) were compared to parental for binding rPD-1.Fc by double staining each population with anti-HA (hemagglutinin) tag expression and the anti-human Fc-PE secondary to detect ligand binding.

Selected variant PD-L2 IgV domains were further formatted as fusion proteins and tested for binding and functional activity as described below.

Example 4

Reformatting Selection Outputs as Fc-Fusions and in Various Immunomodulatory Protein Types Example 4 describes reformatting of selection outputs identified in Example 3 as immunomodulatory proteins containing an affinity modified (variant) immunoglobulin-like V-type (IgV) domain of PD-L2 fused to an Fc molecule (variant IgV domain-Fc fusion molecules).

Output cell pools from final flow cytometric PD-L2 sorts were grown to terminal density in SCD-Leu medium. Plasmid DNA from at least 10× the number of cells of each sort output was isolated using a yeast plasmid DNA isolation kit (Zymo Research, USA). For Fc fusions, PCR primers with added restriction sites suitable for cloning into the Fc fusion vector of choice were used to batch-amplify from the plasmid DNA preps the coding DNA for the mutant target IgV domains After restriction digestion, the PCR products were ligated into Fc fusion vector followed by heat shock transformation into E. coli strain XL1 Blue (Agilent, USA) or NEB5alpha (New England Biolabs) as directed by supplier. Alternatively, the outputs were PCR amplified with primers containing 40 bp overlap regions on either end with Fc fusion vector to carry out in vitro recombination using Gibson Assembly Mastermix (New England Biolabs, USA), which was subsequently used for heat shock transformation into E. coli strain NEB5alpha. Exemplary of an Fc fusion vector is pFUSE-hIgG1-Fc2 (InvivoGen, USA).

Dilutions of transformation reactions were plated on LB-agar containing 100 µg/mL carbenicillin (Teknova, USA) to isolate single colonies for selection. Up to 96 colonies from each transformation were then grown in 96 well plates to saturation overnight at 37° C. in LB-broth (Teknova cat #L8112) and a small aliquot from each well was submitted for DNA sequencing of the IgV domain insert in order to identify mutation(s) in all clones. Sample preparation for DNA sequencing was carried out using protocols provided by the service provider (Genewiz; South Plainfield, N.J.). After removal of sample for DNA sequencing, glycerol was then added to the remaining cultures for a final glycerol content of 25% and plates were stored at −20° C. for future use as master plates (see below). Alternatively, samples for DNA sequencing were generated by replica plating from grown liquid cultures onto solid agar plates using a disposable 96 well replicator (VWR, USA). These plates were incubated overnight to generate growth patches and the plates were submitted to Genewiz as specified by Genewiz.

After analysis of the Genewiz-generated DNA sequencing data, clones of interest were recovered from master plates and individually grown to saturation in liquid LB-broth containing 100 µg/mL carbenicillin (Teknova, USA) and cultures were then used for preparation of plasmid DNA of each clone using a standard kit such as the PureYield Plasmid Miniprep System (Promega, USA) or the MidiPlus kit (Qiagen). Identification of clones of interest from Genewiz sequencing data generally involved the following steps. First, DNA sequence data files were downloaded from the Genewiz web site. All sequences were then manually curated so that they start at the beginning of the IgV domain coding region. The curated sequences were then batch-translated using a suitable program available at the URL: www.ebi.ac.uk/Tools/st/emboss transeq/. The translated sequences were then aligned using a suitable program available at the URL: multalin.toulouse.inra.fr/multalin/multalin.html. Alternatively, Genewiz sequenced were processed to generate alignments using Ugene software (ugene.net).

Clones of interest were then identified from alignments using the following criteria: 1.) identical clone occurs at least two times in the alignment and 2.) a mutation occurs at least two times in the alignment and preferably in distinct clones. Clones that meet at least one of these criteria were assumed to be clones that have been enriched by the sorting process most likely due to improved binding.

To generate recombinant immunomodulatory proteins that are Fc fusion proteins containing an IgV domain of PD-L2 with at least one affinity-modified domain (e.g. variant PD-L2 IgV-Fc), the encoding DNA was generated to encode a protein as follows: variant (mutant) PD-L2 IgV domain followed by a linker of three alanines (AAA) followed by a human IgG1 Fc set forth in SEQ ID NO:1205 containing the mutations R292C, N297G and V302C by EU numbering (corresponding to R77C, N82G and V87C with reference to wild-type human IgG1 Fc set forth in SEQ ID NO: 211). Since the construct does not include any antibody light chains that can form a covalent bond with a cysteine, the human IgG1 Fc also contains replacement of the cysteine residues to a serine residue at position 220 (C220S) by EU numbering (corresponding to position 5 (C5S) with reference to the wild-type or unmodified Fc set forth in SEQ ID NO: 211).

Example 5

Expression and Purification of Fc-Fusions

Example 5 describes the high throughput expression and purification of Fc-fusion proteins containing variant IgV PD-L2 as described in the above Examples.

Recombinant variant Fc fusion proteins were produced from suspension-adapted human embryonic kidney (HEK) 293 cells with Expi293 expression system (Invitrogen, USA). 4 µg of each plasmid DNA from the previous step was added to 200 µL Opti-MEM (Invitrogen, USA) at the same time as 10.84, ExpiFectamine was separately added to another 200 µL Opti-MEM. After 5 minutes, the 200 µL of plasmid DNA was mixed with the 200 µL of ExpiFectamine and was further incubated for an additional 20 minutes before adding this mixture to cells. Ten million Expi293 cells were dispensed into separate wells of a sterile 10 mL, conical bottom, deep 24 well growth plate (Thomson Instrument Company, USA) in a volume 4 mL Expi293 media (Invitrogen, USA). Plates were shaken for 5 days at 120 RPM in a mammalian cell culture incubator set to 95% humidity and 8% $CO_2$. Following a 5-day incubation, cells were pelleted and culture supernatants were retained.

Protein was purified from supernatants using a high throughput 96 well Filter Plate (Thomson Catalog number 931919), each well loaded with 60₄, of Mab SelectSure settled bead (GE Healthcare cat. no. 17543801). Protein was eluted with four consecutive 200 µL fractions of 50 mM Acetate pH3.3. Each fraction's pH was adjusted to above pH 5.0 with 44, 2M Tris pH 8.0. Fractions were pooled and quantitated using 280 nm absorbance measured by Nanodrop instrument (Thermo Fisher Scientific, USA), and protein purity was assessed by loading 5 µg of protein on NUPAGE pre-cast, polyacrylamide gels (Life Technologies, USA) under denaturing and non-reducing conditions and subsequent gel electrophoresis. Proteins were visualized in gel using standard Coomassie staining.

Example 6

Assessment of Binding of Affinity-Matured IgSF Domain-Containing Molecules

A. Binding to Cell-Expressed Counter Structures

This Example describes Fc-fusion binding studies of purified proteins from the above Examples to assess specificity and affinity of PD-L2 domain variant immunomodulatory proteins for the cognate binding partner.

Binding studies were carried out on transfected HEK293 cells generated to express the full-length mammalian surface ligands using Jurkat/IL-2 reporter cells (purchased from Promega Corp. USA) that were then transduced to stably express PD-1 (Jurkat/PD-1). For staining by flow cytometry, 100,000 Jurkat/PD-1 cells or negative control (Jurkat only) were plated in 96 well round bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 μL staining buffer containing 100 nM to 46 pM of each candidate PD-L2 variant Fc fusion protein. As controls, a full extracellular domain of wild-type PD-L2 (composed of one IgV and one IgC domain) fused to Fc ("Full length ECD of PD-L2") and an IgV domain of wild-type PD-L2 ("wild type PD-L2 IgV") or, in some cases, anti-PD-1 monoclonal antibody (nivolumab), were tested. Primary staining was performed on ice for 45 minutes, before washing cells twice in 150 μL staining buffer. PE-conjugated anti-human Fc (Jackson ImmunoResearch, USA) was diluted 1:150 in 50 μl staining buffer and added to cells and incubated another 30 minutes on ice. Secondary antibody was washed out twice, cells were fixed in 4% formaldehyde/PBS, and samples were analyzed on Intellicyt flow cytometer (Intellicyt Corp, USA).

Mean Fluorescence Intensity (MFI) was calculated and compared to wild type PD-L2 IgV with FlowJo Version 10 (FlowJo LLC, USA). Specifically, the binding activity as measured by the Mean Fluorescence Intensity (MFI) value for binding of 50 nM of each variant Fc-fusion molecule to Jurkat/PD-1 cells and the ratio of the MFI compared to the binding of the corresponding wild type (unmodified) PD-L2 IgV fusion molecule not containing the amino acid substitution(s) to PD-1 was determined.

B. ForteBio Octet Binding Assay

Protein-protein interactions between PD-1 and PD-L2 domain variant immunomodulatory proteins were further assessed using Fortebio binding assays. PD-1 was loaded individually onto anti-human capture sensors (ForteBio Octet AHC) and Fc fusions of full length wildtype (unmodified) PD-L2 IgV, full length ECD of PD-L2, full length ECD of PD-L1, or variant PD-L2 Fc-fusion molecules were bound to the PD-1 receptor at a single concentration of 100 nM. As a positive control, anti-PD-1 monoclonal antibody (nivolumab) was also assessed.

Loading response of anti-human capture sensors of each binding protein being tested with the variant IgV-Fc fusion molecule was determined.

C. Results

Results for the binding studies for exemplary tested variant PD-L2 IgV-Fc fusion molecules are shown in Table 10. Table 10 indicates amino acid substitutions in the IgV of the variant PD-L2 selected in the screen described above. In the Table and Figure, the exemplary amino acid substitutions and insertions in the IgV domain are designated by amino acid position number corresponding to amino acid positions in the respective reference unmodified PD-L2 extracellular domain (ECD) sequence set forth in SEQ ID NO:31. The amino acid position is indicated in the middle, with the corresponding unmodified (e.g. wild-type) amino acid listed before the number and the identified variant amino acid substitution (or inserted designated by "ins") listed after the number. Column 2 sets forth the SEQ ID NO identifier for each variant IgV domain contained in the variant IgV-Fc fusion molecule.

Figure 8:
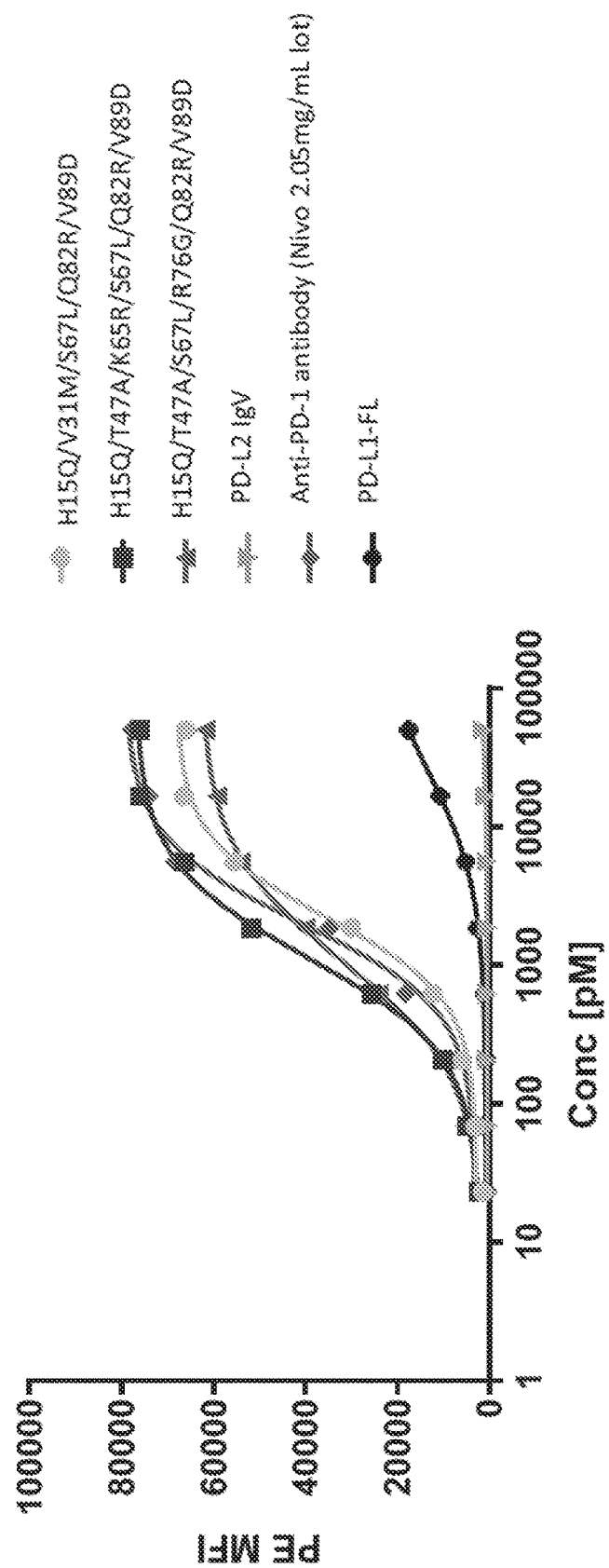
FIG. 8 depicts the MFI for binding to Jurakt/PD-1 cells at various concentrations of PD-L2 variant Fc fusion protein. Binding studies were carried out using Jurkat/IL-2 reporter cells that were then transduced to stably express PD-1 (Jurkat/PD-1). Cells were incubated with indicated concentrations of each candidate PD-L2 variant Fc fusion protein. As controls, a full extracellular domain of wild-type PD-L1 ("PDL1-FL") and an IgV domain of wild-type PD-L2 ("wild type PD-L2 IgV") or, anti-PD-1 monoclonal antibody (nivolumab), were tested. Unbound antibody was removed, bound antibody detected with fluorescently conjugated anti-human IgG, and the cells were analyzed by flow cytometry for MFI.
Figure 9:
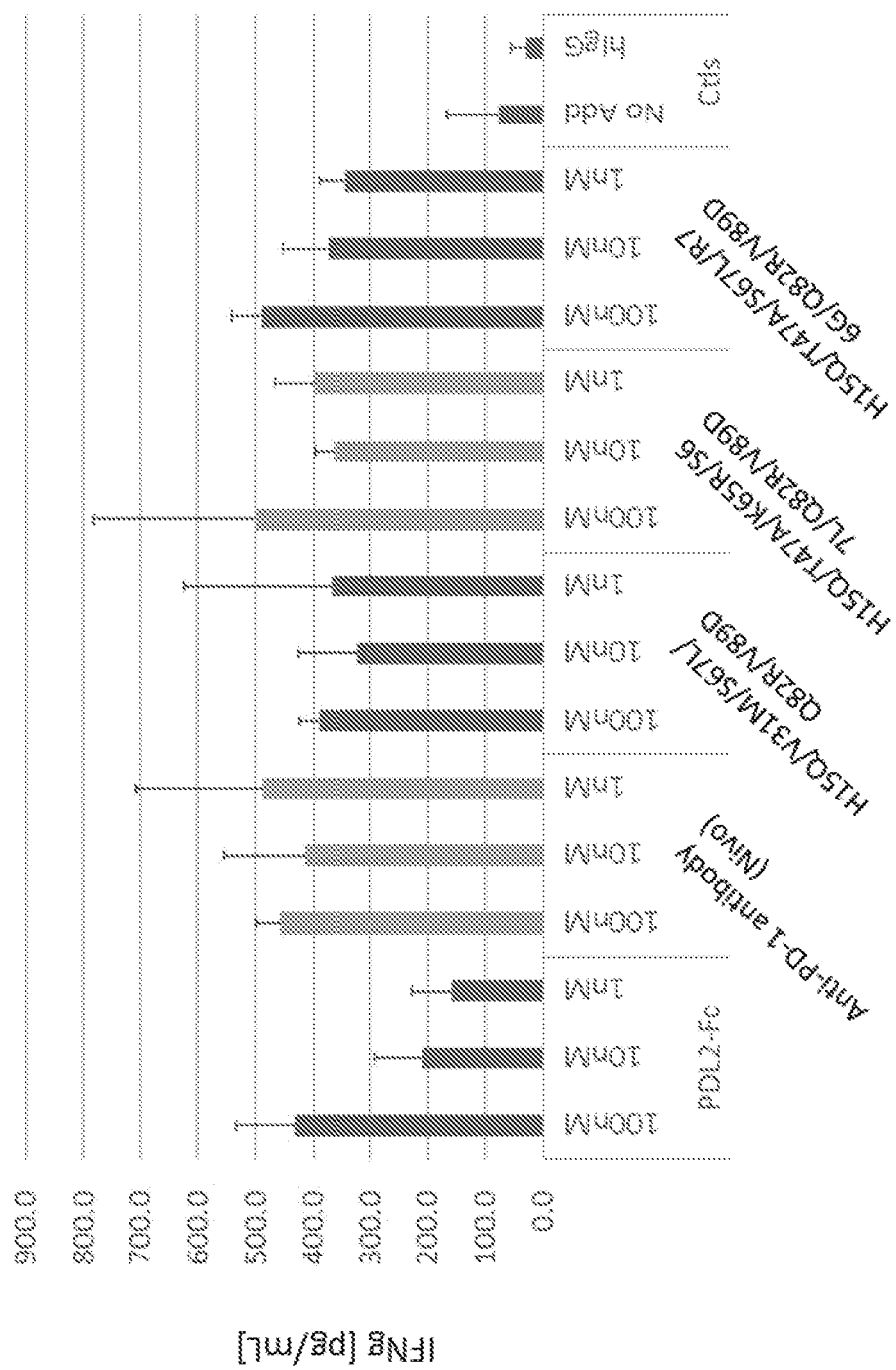
Figure 12A:
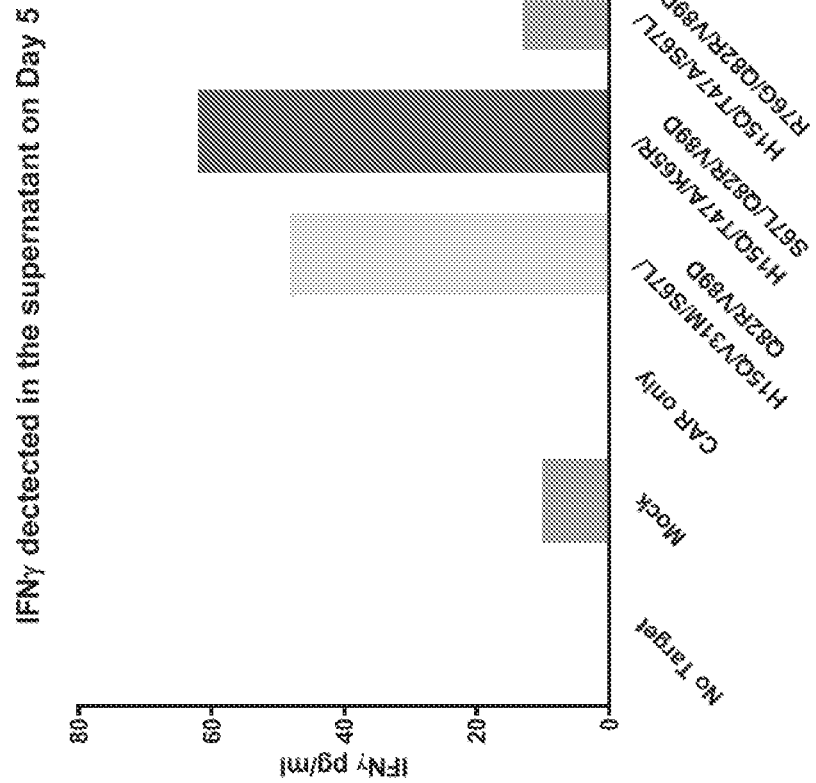
FIG. 12A depicts the proliferation studies for T cells transduced with exemplary tested variant PD-L2 SIP.
Figure 12B:
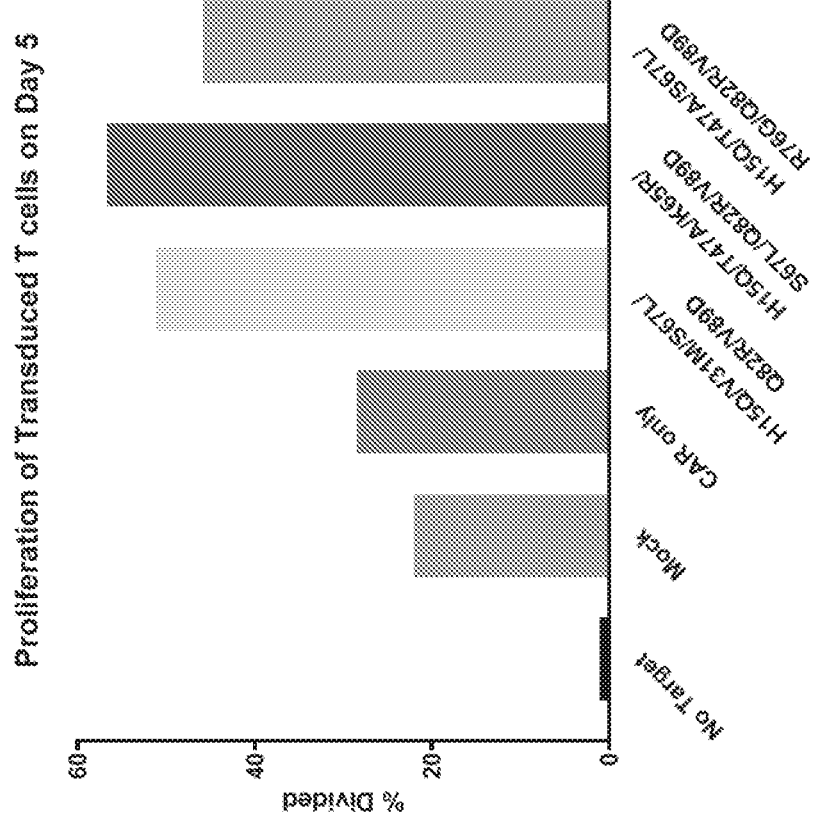
FIG. 12B depicts levels of IFN-gamma in the supernatant released by T cells transduced with exemplary tested variant PD-L2 SIP as measured by ELISA on day 5 after re-stimulation.

As shown in Table 10, the selections resulted in the identification of a number of PD-L2 IgSF (e.g. IgV) domain variants that were affinity-modified to exhibit increased binding for PD-1 as determined by flow cytometry binding studies to Jurkat/PD-1 cells or by Fortebio binding analysis. FIG. 8 depicts the MFI for binding to Jurakt/PD-1 cells at various concentrations of PD-L2 variant Fc fusion protein. As shown in FIG. 8, the tested variants exhibit improved binding to Jurkat/PD-1 compared to PDL2-IgV, and to levels that were similar to anti-PD-1 monoclonal antibody (nivolumab).

TABLE 10

Variant PD-L2 selected against PD-1. Molecule sequence and binding data.

| | | Binding to Jurkat/ PD-1 Cells | | Fortebio binding |
|---|---|---|---|---|
| PD-L2 mutation(s) | SEQ ID NO (IgV) | MFI at 50 nM | Fold increase over wildtype PD-L2 IgV-Fc | to PD-1-Fc Response Units |
| H15Q | 268 | 15998 | 1.63 | 0.007 |
| N24D | 269 | 1414 | 0.14 | −0.039 |
| E44D | 270 | 2928 | 0.3 | −0.006 |
| V89D | 271 | 3361 | 0.34 | 0.005 |
| Q82R,V89D | 272 | 44977 | 4.57 | 1.111 |
| E59G,Q82R | 273 | 12667 | 1.29 | −0.028 |
| S39I,V89D | 274 | 26130 | 2.65 | 0.26 |
| S67L,V89D | 275 | 15991 | 1.62 | 0.608 |
| S67L,I85F | 276 | 529 | 0.05 | −0.005 |
| S67L,I86T | 277 | 6833 | 0.69 | 0.141 |
| H15Q,K65R | 278 | 13497 | 1.37 | −0.001 |
| H15Q,Q72H,V89D | 279 | 12629 | 1.28 | 0.718 |
| H15Q,S67L,R76G | 280 | 47201 | 4.8 | 0.418 |
| H15Q,R76G,I85F | 281 | 2941 | 0.3 | −0.038 |
| H15Q,T47A,Q82R | 282 | 65174 | 6.62 | 0.194 |
| H15Q,Q82R,V89D | 283 | 49652 | 5.04 | 1.198 |
| H15Q,C23S,I86T | 284 | 830 | 0.08 | −0.026 |
| H15Q,S39I,I86T | 285 | 1027 | 0.1 | 0.309 |
| H15Q,R76G,I85F | 286 | 1894 | 0.19 | −0.006 |
| E44D,V89D,W91R | 287 | 614 | 0.06 | −0.048 |
| I13V,S67L,V89D | 288 | 26200 | 2.66 | 1.42 |
| H15Q,S67L,I86T | 289 | 15952 | 1.62 | 0.988 |
| I13V,H15Q,S67L,I86T | 290 | 21570 | 2.19 | 1.391 |
| I13V,H15Q,E44D,V89D | 291 | 23958 | 2.43 | 1.399 |
| I13V,S39I,E44D,Q82R,V89D | 292 | 71423 | 7.26 | 0.697 |
| I13V,E44D,Q82R,V89D | 293 | 45191 | 4.59 | 1.283 |
| I13V,Q72H,R76G,I86T | 294 | 10429 | 1.06 | 0.733 |
| I13V,H15Q,R76G,I85F | 295 | 4736 | 0.48 | −0.04 |
| H15Q,S67L,R76G,I85F | 297 | 2869 | 0.29 | 0.025 |
| H15Q,S39I,R76G,V89D | 298 | Little or no protein produced | | |
| H15Q,T47A,Q72H,R76G,I86T | 298 | 32103 | 3.26 | 0.512 |
| H15Q,T47A,Q72H,R76G | 299 | 16500 | 1.68 | 0.327 |
| I13V,H15Q,T47A,Q72H,R76G | 300 | 73412 | 7.46 | 0.896 |
| H15Q,E44D,R76G,I85F | 301 | 2885 | 0.29 | −0.013 |
| H15Q,S39I,S67L,V89D | 302 | 45502 | 4.62 | 1.174 |
| H15Q,N32D,S67L,V89D | 303 | 25880 | 2.63 | 1.407 |
| N32D,S67L,V89D | 304 | 31753 | 3.23 | 1.155 |
| H15Q,S67L,Q72H,R76G,V89D | 305 | 40180 | 4.08 | 1.464 |
| H15Q,Q72H,Q74R,R76G,I86T | 306 | 4049 | 0.41 | 0.093 |
| G28V,Q72H,R76G,I86T | 307 | 5563 | 0.57 | 0.003 |
| I13V,H15Q,S39I,E44D,S67L | 308 | 63508 | 6.45 | 0.889 |
| E44D,S67L,Q72H,Q82R,V89D | 309 | 51467 | 5.23 | 1.061 |
| H15Q,V89D | 310 | 17672 | 1.8 | 0.31 |
| H15Q,T47A | 311 | 26578 | 2.7 | 0.016 |
| I13V,H15Q,Q82R | 312 | 76146 | 7.74 | 0.655 |
| I13V,H15Q,V89D | 313 | 28745 | 2.92 | 1.331 |
| I13V,S67L,Q82R,V89D | 314 | 58992 | 5.99 | 1.391 |
| I13V,H15Q,Q82R,V89D | 315 | 49523 | 5.03 | 1.419 |
| H15Q,V31M,S67L,Q82R,V89D | 316 | 67401 | 6.85 | 1.37 |
| I13V,H15Q,T47A,Q82R | 317 | 89126 | 9.05 | 0.652 |
| I13V,H15Q,V31A,N45S,Q82R,V89D | 318 | 68016 | 6.91 | 1.327 |
| I13V, T20A, T47A, K65X*, Q82R, V89D | 319 | 36743 | 3.73 | 0.092 |
| H15Q,T47A,H69L,Q82R,V89D | 320 | 65598 | 6.66 | 1.44 |
| I13V,H15Q,T47A,H69L,R76G,V89D | 321 | 54340 | 5.52 | 1.719 |
| I12V,I13V,H15Q,T47A,Q82R,V89D | 322 | 61207 | 6.22 | 1.453 |

TABLE 10-continued

Variant PD-L2 selected against PD-1. Molecule sequence and binding data.

| PD-L2 mutation(s) | SEQ ID NO (IgV) | Binding to Jurkat/ PD-1 Cells MFI at 50 nM | Binding to Jurkat/ PD-1 Cells Fold increase over wildtype PD-L2 IgV-Fc | Fortebio binding to PD-1-Fc Response Units |
|---|---|---|---|---|
| I13V,H15Q,R76G,D77N,Q82R,V89D | 323 | 33079 | 3.36 | 0.065 |
| I13V,H15Q,T47A,R76G,V89D | 324 | 53668 | 5.45 | 1.596 |
| I13V,H15Q,T47A,Q82R,V89D | 325 | 63320 | 6.43 | 1.418 |
| I13V,H15Q,T47A,Q82R,V89D | 325 | 60980 | 6.2 | 1.448 |
| I13V,H15Q,I36V,T47A,S67L,V89D | 327 | 52835 | 5.37 | 1.627 |
| H15Q,T47A,K65R,S67L,Q82R,V89D | 328 | 79692 | 8.1 | 1.453 |
| H15Q,L33P,T47A,S67L,P71S,V89D | 329 | 45726 | 4.65 | 1.467 |
| I13V,H15Q,Q72H,R76G,I86T | 330 | 24450 | 2.48 | 1.355 |
| H15Q,T47A,S67L,Q82R,V89D | 331 | 67962 | 6.9 | 1.479 |
| F2L,H15Q,D46E,T47A,Q72H,R76G,Q82R,V89D | 332 | 23039 | 2.34 | 1.045 |
| I13V,H15Q,L33F,T47A,Q82R,V89D | 333 | 62254 | 6.32 | 1.379 |
| H15Q,N24S,T47A,Q72H,R76G,V89D | 335 | 32077 | 3.26 | 0.4 |
| I13V,H15Q,E44V,T47A,Q82R,V89D | 336 | 61005 | 6.2 | 1.329 |
| H15Q,N18D,T47A,Q72H,V73A,R76G,I86T,V89D | 337 | 48317 | 4.91 | 0.475 |
| I13V,H15Q,T37A,E44D,S48C,S67L,Q82R,V89D | 338 | 47605 | 4.84 | 1.255 |
| H15Q,L33H,S67L,R76G,Q82R,V89D | 339 | 62326 | 6.33 | 1.507 |
| I13V,H15Q,T47A,Q72H,R76G,I86T | 340 | 49016 | 4.98 | 1.477 |
| H15Q,S39I,E44D,Q72H,V75G,R76G,Q82R,V89D | 341 | 43713 | 4.44 | 0.646 |
| H15Q,T47A,S67L,R76G,Q82R,V89D | 342 | 71897 | 7.3 | 1.539 |
| I13V,H15Q,T47A,S67L,Q72H,R76G,Q82R,V89D | 343 | 71755 | 7.29 | 1.536 |
| Wild Type PD-L2 IgV | 115 | 9843 | 1 | −0.024 |
| Full length ECD of PD-L2 | 31 | 2145 | 0.22 | 0.071 |
| Full length ECD of PD-L1 (R&D Systems) | 30 | 23769 | 2.41 | 1.263 |
| Anti-PD-1 monoclonal antibody (nivolumab) | — | 87002 | 8.84 | 0.899 |

*stop codon at indicated position

Example 7

Assessment of Activity of Affinity-Matured IgSF Domain-Containing Molecules with Mixed Lymphocyte Reaction (MLR)

This Example describes Fc-fusion variant protein bioactivity characterization in human primary T cell in vitro assays.

Soluble variant PD-L2 IgV-Fc bioactivity was tested in a human Mixed Lymphocyte Reaction (MLR). Human primary dendritic cells (DC) were generated by culturing monocytes isolated from PBMC (BenTech Bio, USA) in vitro for 7 days with 50 ng/mL rIL-4 (R&D Systems, USA) and 80 ng/mL rGM-CSF (R&D Systems, USA) in Ex-Vivo 15 media (Lonza, Switzerland). To fully induce DC maturation, lipopolysaccharide (LPS) (InvivoGen Corp., USA) was added at 100 ng/mL to the DC cultures on day 6 and cells were incubated for an additional 24 hours. Approximately, 10,000 matured DC and 100,000 purified allogeneic CD4+ T cells (BenTech Bio, USA) were co-cultured with several concentrations of variant PD-L2 IgV-Fc fusion proteins in 96 well round-bottom plates in 200 μL final volume of Ex-Vivo 15 media. Irrelevant human IgG or media only (designated "No Add") were used as negative controls. As positive controls, either wildtype PDL2-Fc (full PD-L2 extracellular domain), wildtype PD-L2 IgV-Fc and or positive control anti-PD-1 monoclonal antibody (nivolumab) was assessed. On day 5, IFN-gamma secretion in culture supernatants was analyzed using the Human IFN-gamma Duoset ELISA kit (R&D Systems, USA). Optical density was measured on a BioTek Cytation Multimode Microplate Reader (BioTek Corp., USA) and quantitated against titrated rIFN-gamma standard included in the IFN-gamma Duo-set kit (R&D Systems, USA).

Results for the bioactivity studies for exemplary tested variant PD-L2 IgV-Fc are shown in Table 11, which sets forth the calculated levels of IFN-gamma in culture supernatants (pg/mL) at the tested concentration of variant IgV-Fc fusion molecule. Also shown in Table 11 is the fold increase in IFN-gamma levels of each variant IgV-Fc fusion molecule compared to the IFN-gamma levels of the corresponding unmodified (wildtype) IgV-Fc fusion molecule not containing the amino acid substitution(s). The variants are identified with reference to the amino acid substitutions in the IgV of PD-L2 with reference to positions corresponding to positions of the unmodified (wildtype) PD-L2 ECD sequence set forth in SEQ ID NO:31.

Exemplary variant PD-L2 IgV-Fc fusion proteins in Table 11 were further tested in an MLR at various increasing concentrations as indicated in FIG. 9 and FIG. 10. As shown in FIG. 9, exemplary variant PD-L2 IgV-Fc molecules exhibited improved activities to increase IFN-gamma production in an MLR assay. As shown in FIGS. 9 and 10, the exemplary variant PD-L2 IgV-Fc fusion molecules tested show comparable activity to nivolumab in the MLR assay.

TABLE 11

Bioactivity Data of PD-L2 variants selected against PD-1 in MLR.

| PD-L2 mutation(s) | SEQ ID NO (IgV) | IFN gamma levels pg/mL | Fold increase over wildtype PD-L2 IgV-Fc |
|---|---|---|---|
| H15Q | 268 | 1817.1 | 1.32 |
| N24D | 269 | 1976.3 | 1.44 |
| E44D | 270 | 1499.4 | 1.09 |
| V89D | 271 | 1168.1 | 0.85 |
| Q82R,V89D | 272 | 1617 | 1.17 |
| E59G,Q82R | 273 | 1511.3 | 1.1 |
| S39I,V89D | 274 | 1314.5 | 0.95 |
| S67L,V89D | 275 | 1230.1 | 0.89 |
| S67L,I85F | 276 | 1281.9 | 0.93 |
| S67L,I86T | 277 | 1020.4 | 0.74 |
| H15Q,K65R | 278 | 1510.8 | 1.1 |
| H15Q,Q72H,V89D | 279 | 1272.2 | 0.92 |
| H15Q,S67L,R76G | 280 | 1426.2 | 1.04 |
| H15Q,R76G,185F | 281 | 1725.7 | 1.25 |
| H15Q,T47A,Q82R | 282 | 1317.9 | 0.96 |
| H15Q,Q82R,V89D | 283 | 1081.2 | 0.79 |
| H15Q,C23S,I86T | 284 | 1847.2 | 1.34 |
| H15Q,S39I,I86T | 285 | 1415.2 | 1.03 |
| H15Q,R76G,I85F | 286 | 1437.8 | 1.04 |
| E44D,V89D,W91R | 287 | 1560.1 | 1.13 |
| I13V,S67L,V89D | 288 | 867.5 | 0.63 |
| H15Q,S67L,I86T | 289 | 1034.2 | 0.75 |
| I13V,H15Q,S67L,I86T | 290 | 1014.4 | 0.74 |
| I13V,H15Q,E44D,V89D | 291 | 1384.2 | 1.01 |
| I13V,S39I,E44D,Q82R,V89D | 292 | 935.6 | 0.68 |
| I13V,E44D,Q82R,V89D | 293 | 1009.5 | 0.73 |
| I13V,Q72H,R76G,I86T | 294 | 1953 | 1.42 |
| I13V,H15Q,R76G,I85F | 295 | 1528.5 | 1.11 |
| H15Q,S67L,R76G,I85F | 297 | 1318.7 | 0.96 |
| H15Q,T47A,Q72H,R76G,I86T | 298 | 1599.6 | 1.16 |
| H15Q,T47A,Q72H,R76G | 299 | 1462.5 | 1.06 |
| I13V,H15Q,T47A,Q72H,R76G | 300 | 1469.8 | 1.07 |
| H15Q,E44D,R76G,185F | 301 | 1391.6 | 1.01 |
| H15Q,S39I,S67L,V89D | 302 | 1227 | 0.89 |
| H15Q,N32D,S67L,V89D | 303 | 1285.7 | 0.93 |
| N32D,S67L,V89D | 304 | 1194 | 0.87 |
| H15Q,S67L,Q72H,R76G,V89D | 305 | 1061.2 | 0.77 |
| H15Q,Q72H,Q74R,R76G,I86T | 306 | 933.8 | 0.68 |
| G28V,Q72H,R76G,I86T | 307 | 1781.6 | 1.29 |
| I13V,H15Q,S391,E44D,S67L | 308 | 1256.9 | 0.91 |
| E44D,S67L,Q72H,Q82R,V89D | 309 | 1281.4 | 0.93 |
| H15Q,V89D | 310 | 1495.4 | 1.09 |
| H15Q,T47A | 311 | 1637.2 | 1.19 |
| I13V,H15Q,Q82R | 312 | 1432.9 | 1.04 |
| I13V,H15Q,V89D | 313 | 1123 | 0.82 |
| I13V,S67L,Q82R,V89D | 314 | 1372.8 | 1 |
| I13V,H15Q,Q82R,V89D | 315 | 1596.6 | 1.16 |
| H15Q,V31M,S67L,Q82R,V89D | 316 | 1206.5 | 0.88 |
| I13V,H15Q,T47A,Q82R | 317 | 1703.3 | 1.24 |
| I13V,H15Q,V31A,N45S,Q82R,V89D | 318 | 1723.1 | 1.25 |
| I13V, T20A, T47A, K65X, Q82R, V89D | 319 | 1378.8 | 1 |
| H15Q,T47A,H69L,Q82R,V89D | 320 | 1732.5 | 1.26 |
| I13V,H15Q,T47A,H69L,R76G,V89D | 321 | 1075.5 | 0.78 |
| I12V,I13V,H15Q,T47A,Q82R,V89D | 322 | 1533.2 | 1.11 |
| I13V,H15Q,R76G,D77N,Q82R,V89D | 323 | 1187.9 | 0.86 |
| I13V,H15Q,T47A,R76G,V89D | 324 | 1253.7 | 0.91 |
| I13V,H15Q,T47A,Q82R,V89D | 325 | 1445.5 | 1.05 |
| I13V,H15Q,T47A,Q82R,V89D | 325 | 1737 | 1.26 |
| I13V,H15Q,I36V,T47A,S67L,V89D | 327 | 1357.4 | 0.99 |
| H15Q,T47A,K65R,S67L,Q82R,V89D | 328 | 1335.3 | 0.97 |
| H15Q,L33P,T47A,S67L,P71S,V89D | 329 | 1289.1 | 0.94 |
| I13V,H15Q,Q72H,R76G,I86T | 330 | 1221 | 0.89 |
| H15Q,T47A,S67L,Q82R,V89D | 331 | 1197.1 | 0.87 |
| F2L,H15Q,D46E,T47A,Q72H,R76G,Q82R,V89D | 332 | 1170.7 | 0.85 |
| I13V,H15Q,L33F,T47A,Q82R,V89D | 333 | 1468.4 | 1.07 |
| I13V,H15Q,T47A,E58G,S67L,Q82R,V89D | 334 | 836.1 | 0.61 |
| H15Q,N24S,T47A,Q72H,R76G,V89D | 335 | 1091.8 | 0.79 |
| I13V,H15Q,E44V,T47A,Q82R,V89D | 336 | 1270.5 | 0.92 |
| H15Q,N18D,T47A,Q72H,V73A,R76G,I86T,V89D | 337 | 1065.8 | 0.77 |
| I13V,H15Q,T37A,E44D,S48C,S67L,Q82R,V89D | 338 | 1751.7 | 1.27 |
| H15Q,L33H,S67L,R76G,Q82R,V89D | 339 | 1502 | 1.09 |

TABLE 11-continued

| Bioactivity Data of PD-L2 variants selected against PD-1 in MLR. | | | |
|---|---|---|---|
| PD-L2 mutation(s) | SEQ ID NO (IgV) | IFN gamma levels pg/mL | Fold increase over wildtype PD-L2 IgV-Fc |
| I13V,H15Q,T47A,Q72H,R76G,I86T | 340 | 1088.1 | 0.79 |
| H15Q,S39I,E44D,Q72H,V75G,R76G,Q82R,V89D | 341 | 940.9 | 0.68 |
| H15Q,T47A,S67L,R76G,Q82R,V89D | 342 | 1097.8 | 0.8 |
| I13V,H15Q,T47A,S67L,Q72H,R76G,Q82R,V89D | 343 | 1559.6 | 1.13 |
| Wild Type PD-L2 IgV | 115 | 1376.8 | 1 |
| Full length ECD of PD-L2 | 31 | 1173.2 | 0.85 |
| Full length ECD of PD-L1 | 30 | 2190.9 | 1.59 |
| Nivolumab (anti-PD-1) | — | 418.9 | 0.3 |

Example 8

Additional Affinity Modified IgSF Domains

This examples describe the design, creation, and screening of additional affinity modified CD80 (B7-1), PD-L1, CD155 and CD112 and CD86 (B7-2) immunomodulatory proteins, which are other components of the immune synapse (IS) that have a demonstrated dual role in both immune activation and inhibition. Affinity-modified NKp30 variants also were generated and screened. These examples demonstrate that affinity modification of IgSF domains yields proteins that can act to both increase and decrease immunological activity. Various combinations of those domains fused in pairs (i.e., stacked) with a variant affinity modified PD-L2 to form a Type II immunomodulatory protein to achieve immunomodulatory activity.

Mutant DNA constructs of encoding a variant of the ECD domain of human CD80, or IgV domains of PD-L1, CD155 and CD112 for translation and expression as yeast display libraries were generated substantially as described in Example 1. Target libraries that target specific residues for complete or partial randomization with degenerate codons and/or random libraries were constructed to identify variants of the IgV of CD80 (SEQ ID NO:2039), variants of the ECD or IgV of PD-L1 (SEQ ID NO: 1454), variants of the IgV of CD155 (SEQ ID NO:387), and variants of the IgV of CD112 (SEQ ID NO:795) substantially as described in Example 1. Similar methods also were used to generate libraries of the IgC-like domain of NKp30 (SEQ ID NO:1238).

The degenerate or random library DNA was introduced into yeast substantially as described in Example 2 to generate yeast libraries. The libraries were used to select yeast expressing affinity modified variants of CD80, PD-L1, CD155, CD112, CD86 (B7-2), and NKp30 substantially as described in Example 3. Cells were processed to reduce non-binders and to enrich for CD80, PD-L1, CD155 or CD112, CD86 (B7-2), and NKp30 variants with the ability to bind their exogenous recombinant counter-structure proteins substantially as described in Example 3.

With CD80, CD86 and NKp30 libraries, target ligand proteins were sourced from R&D Systems (USA) as follows: human rCD28.Fc (i.e., recombinant CD28-Fc fusion protein), rPDL1.Fc, rCTLA4.Fc, and rB7H6.Fc. Two-color flow cytometry was performed substantially as described in Example 3. Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

In the case of NKp30 yeast variants selected for binding to B7-H6, the F2 sort outputs gave MFI values of 533 when stained with 16.6 nM rB7H6.Fc, whereas the parental NKp30 strain MFI was measured at 90 when stained with the same concentration of rB7H6.Fc (6-fold improvement).

Among the NKp30 variants that were identified, was a variant that contained mutations L30V/A60V/S64P/S86G with reference to positions in the NKp30 extracellular domain corresponding to positions set forth in SEQ ID NO:54.

For CD80 variants provided in Table 12A-B, CD80 libraries consisted of positive selection with the desired counter structure CTLA4 and negative selection with the counter structure CD28.

For CD155 variants provided in Table 13A, CD155 libraries were selected against each of TIGIT, CD96, and CD226, separately. For CD155 variants provided in Table 13B-F, selection involved two positive selections with the desired counter structures TIGIT and CD96 followed by one negative selection with the counter structure CD226 to select away from CD226 and improve binding specificity of the variant CD155. Selection was performed essentially as described in Example 3 above except the concentrations of the counter structures (TIGIT/CD96) and selection stringency of the positive sorts were varied to optimize lead identification. The concentration of CD226 for the negative selection was kept at 100 nM.

For CD112 variants provided in Table 14A, CD112 libraries were selected against each of TIGIT, CD112R, and CD226, separately. For additional CD112 variants provided in Table 14B-14C, selection involved two positive selections with the desired counter structures TIGIT and CD112R followed by one negative selection with the counter structure CD226 to select away from CD226 and improve binding specificity of the variant CD112. Selection was performed essentially as described in Example 3 above except the concentrations of the counter structures (TIGIT/CD112R) and selection stringency of the positive sorts were varied to optimize lead identification. The concentration of CD226 for the negative selection was kept at 100 nM.

For PD-L1 variants provided in Table 15, yeast display targeted or random PD-L1 libraries were selected against PD-1. This was then followed by two to three rounds of flow cytometry sorting using exogenous counter-structure protein staining to enrich the fraction of yeast cells that displays improved binders. Alternatively, for PD-L1, selections were performed with human rCD80.Fc (i.e., human recombinant CD80 Fc fusion protein from R&D Systems, USA). Selections were carried out largely as described for PD-1. Magnetic bead enrichment and selections by flow cytometry are essentially as described in Miller K. D., Current Protocols in Cytometry 4.7.1-4.7.30, July 2008. PD-L1 variants in Table 15A-B were assessed for binding to cell-expressed counter structures. Additional PD-L1 variants identified in the screen as described above are set forth in Table 15C.

Exemplary selection outputs were reformatted as immunomodulatory proteins containing an affinity modified (variant) IgV of CD80, variant IgV of PD-L1, variant IgV of CD155, variant IgV of CD112, each fused to an Fc molecule (variant ECD-Fc fusion molecules or variant IgV-Fc fusion molecules) substantially as described in Example 4 and the Fc-fusion protein was expressed and purified substantially as described in Example 5.

Binding of exemplary IgSF domain variants to cell-expressed counter structures was then assessed substantially as described in Example 6. Cells expressing cognate binding partners were produced and binding studies and flow cytometry were carried out substantially as described in Example 6. In addition, the bioactivity of the Fc-fusion variant protein was characterized by either mixed lymphocyte reaction (MLR) or anti-CD3 coimmobilization assay substantially as described in Example 6.

As above, for each Table, the exemplary amino acid substitutions are designated by amino acid position number corresponding to the respective reference unmodified ECD sequence (Table 2). The amino acid position is indicated in the middle, with the corresponding unmodified (e.g. wild-type) amino acid listed before the number and the identified variant amino acid substitution listed (or inserted designated by a) after the number.

Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding unmodified Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma in culture supernatants (pg/mL) generated either i) with the indicated variant Fc fusion molecule coimmoblized with anti-CD3 or ii) with the indicated variant Fc fusion molecule in an MLR assay. The Tables also depict the ratio of IFN-gamma produced by each variant ECD-Fc or IgV-Fc compared to the corresponding unmodified ECD-Fc or IgV-Fc in the functional assays.

As shown in Tables 12A-15, the selections resulted in the identification of a number of PD-L1, CD155, CD112, and CD80 IgSF domain variants that were affinity-modified to exhibit increased binding for at least one, and in some cases more than one, cognate counter structure ligand. In addition, the results showed that affinity modification of the variant molecules also exhibited improved activities to both increase and decrease immunological activity depending on the format of the molecule.

TABLE 12A

Variant CD80 Binding to HEK293 Cells Transfected with CTLA4, CD28 or PD-L1

| CD80 mutation(s) | SEQ ID NO (IgV) | CTLA4 MFI at 66.6 nM | CTLA4 Fold change to WT | CD28 MFI at 66.6 nM | CD28 Fold change to WT | PD-L1 MFI at 22.2 nM | PD-L1 Fold change to WT | Ratio of CTLA4:CD28 |
|---|---|---|---|---|---|---|---|---|
| L70P | 1114 | | | Not tested | | | | |
| I30F/L70P | 1115 | | | Not tested | | | | |
| Q27H/T41S/A71D | 1116 | 368176 | 2.3 | 25051 | 1.01 | 24181 | N/A | 14.7 |
| I30T/L70R | 1117 | 2234 | 0.0 | 2596 | 0.10 | 5163 | N/A | 0.9 |
| T13R/C16R/L70Q/A71D | 1118 | 197357 | 1.2 | 16082 | 0.65 | 9516 | N/A | 12.3 |
| T57I | 1119 | 393810 | 2.4 | 23569 | 0.95 | 3375 | N/A | 16.7 |
| M43I/C82R | 1120 | 3638 | 0.0 | 3078 | 0.12 | 7405 | N/A | 1.2 |
| V22L/M38V/M47T/A71D/L85M | 1121 | 175235 | 1.1 | 3027 | 0.12 | 6144 | N/A | 57.9 |
| I30V/T57I/L70P/A71D/A91T | 1122 | 116085 | 0.7 | 10129 | 0.41 | 5886 | N/A | 11.5 |
| V22I/L70M/A71D | 1123 | 163825 | 1.0 | 22843 | 0.92 | 33404 | N/A | 7.2 |
| N55D/L70P/E77G | 1124 | | | Not tested | | | | |
| T57A/I69T | 1125 | | | Not tested | | | | |
| N55D/K86M | 1126 | 3539 | 0.0 | 3119 | 0.13 | 5091 | N/A | 1.1 |
| L72P/T79I | 1127 | 50176 | 0.3 | 3397 | 0.14 | 6023 | N/A | 14.8 |
| L70P/F92S | 1128 | 4035 | 0.0 | 2948 | 0.12 | 6173 | N/A | 1.4 |
| T79P | 1129 | 2005 | 0.0 | 2665 | 0.11 | 4412 | N/A | 0.8 |
| E35D/M47I/L65P/D90N | 1130 | 4411 | 0.0 | 2526 | 0.10 | 4034 | N/A | 1.7 |
| L25S/E35D/M47I/D90N | 1131 | 61265 | 0.4 | 4845 | 0.20 | 20902 | N/A | 12.6 |
| Q27X*/S44P/I67T/P74S/E81G/E95D | 1132 | 195637 | 1.2 | 17524 | 0.71 | 17509 | N/A | 11.2 |
| A71D | 1133 | 220090 | 1.4 | 16785 | 0.68 | 29642 | N/A | 13.1 |
| T13A/Q27X*/I61N/A71D | 1134 | 195061 | 1.2 | 17519 | 0.71 | 21717 | N/A | 11.1 |
| E81K/A91S | 1135 | 98467 | 0.6 | 3309 | 0.13 | 44557 | N/A | 29.8 |
| A12V/M47V/L70M | 1136 | 81616 | 0.5 | 7400 | 0.30 | 31077 | N/A | 11.0 |
| K34E/T41A/L72V | 1137 | 88982 | 0.6 | 3755 | 0.15 | 35293 | N/A | 23.7 |
| T41S/A71D/V84A | 1138 | 103010 | 0.6 | 5573 | 0.22 | 83541 | N/A | 18.5 |
| E35D/A71D | 1139 | 106069 | 0.7 | 18206 | 0.73 | 40151 | N/A | 5.8 |
| E35D/M47I | 1140 | 353590 | 2.2 | 14350 | 0.58 | 149916 | N/A | 24.6 |
| K36R/G78A | 1141 | 11937 | 0.1 | 2611 | 0.11 | 5715 | N/A | 4.6 |
| Q33E/T41A | 1142 | 8292 | 0.1 | 2442 | 0.10 | 3958 | N/A | 3.4 |
| M47V/N48H | 1143 | 207012 | 1.3 | 14623 | 0.59 | 145529 | N/A | 14.2 |
| M47L/V68A | 1144 | 74238 | 0.5 | 13259 | 0.53 | 11223 | N/A | 5.6 |

TABLE 12A-continued

Variant CD80 Binding to HEK293 Cells Transfected with CTLA4, CD28 or PD-L1

| CD80 mutation(s) | SEQ ID NO (IgV) | CTLA4 MFI at 66.6 nM | CTLA4 Fold change to WT | CD28 MFI at 66.6 nM | CD28 Fold change to WT | PD-L1 MFI at 22.2 nM | PD-L1 Fold change to WT | Ratio of CTLA4:CD28 |
|---|---|---|---|---|---|---|---|---|
| S44P/A71D | 1145 | 8839 | 0.1 | 2744 | 0.11 | 6309 | N/A | 3.2 |
| Q27H/M43I/A71D/R73S | 1146 | 136251 | 0.8 | 12391 | 0.50 | 8242 | N/A | 11.0 |
| E35D/T57I/L70Q/A71D | 1148 | 121901 | 0.8 | 21284 | 0.86 | 2419 | N/A | 5.7 |
| M47I/E88D | 1149 | 105192 | 0.7 | 7337 | 0.30 | 97695 | N/A | 14.3 |
| M42I/I61V/A71D | 1150 | 54478 | 0.3 | 6074 | 0.24 | 4226 | N/A | 9.0 |
| P51A/A71D | 1151 | 67256 | 0.4 | 4262 | 0.17 | 5532 | N/A | 15.8 |
| H18Y/M47I/T57I/A71G | 1152 | 136455 | 0.8 | 20081 | 0.81 | 13749 | N/A | 6.8 |
| V20I/M47V/T57I/V84I | 1153 | 183516 | 1.1 | 26922 | 1.08 | 3583 | N/A | 6.8 |
| WT | 2039 | 161423 | 1.0 | 24836 | 1.00 | Not tested | N/A | 6.5 |

*Stop codon at indicated position

TABLE 12B

Variant CD80 Binding to HEK293 Cells Transfected with CTLA4, CD28 or PD-L1

| CD80 mutation(s) | SEQ ID NO (IgV) | CTLA4 MFI at 66.6 nM | CTLA4 Fold change to WT | CD28 MFI at 66.6 nM | CD28 Fold change to WT | PD-L1 MFI at 22.2 nM | PD-L1 Fold change to WT | Ratio of CTLA4:CD28 |
|---|---|---|---|---|---|---|---|---|
| V20I/M47V/A71D | 1154 | 149937 | 7.23 | 15090 | 9.33 | 9710 | 5.48 | 9.9 |
| A71D/L72V/E95K | 1155 | 140306 | 6.77 | 6314 | 3.90 | 8417 | 4.75 | 22.2 |
| V22L/E35G/A71D/L72P | 1156 | 152588 | 7.36 | 8150 | 5.04 | 1403 | 0.79 | 18.7 |
| E35D/A71D | 1157 | 150330 | 7.25 | 14982 | 9.26 | 13781 | 7.77 | 10.0 |
| E35D/I67L/A71D | 1158 | 146087 | 7.04 | 11175 | 6.91 | 9354 | 5.28 | 13.1 |
| T13R/M42V/M47I/A71D | 1160 | 108900 | 5.25 | 16713 | 10.33 | 1869 | 1.05 | 6.5 |
| E35D | 1161 | 116494 | 5.62 | 3453 | 2.13 | 25492 | 14.38 | 33.7 |
| E35D/M47I/L70M | 1162 | 116531 | 5.62 | 14395 | 8.90 | 49131 | 27.71 | 8.1 |
| E35D/A71/L72V | 1163 | 134252 | 6.47 | 11634 | 7.19 | 13125 | 7.40 | 11.5 |
| E35D/M43L/L70M | 1164 | 102499 | 4.94 | 3112 | 1.92 | 40632 | 22.92 | 32.9 |
| A26P/E35D/M43I/L85Q/E88D | 1165 | 83139 | 4.01 | 5406 | 3.34 | 9506 | 5.36 | 15.4 |
| E35D/D46V/L85Q | 1166 | 85989 | 4.15 | 7510 | 4.64 | 38133 | 21.51 | 11.4 |
| Q27L/E35D/M47I/T57I/L70Q/E88D | 1167 | 59793 | 2.88 | 14011 | 8.66 | 1050 | 0.59 | 4.3 |
| Q27H/E35G/A71D/L72P/T79I | 1159 | 85117 | 4.10 | 10317 | 6.38 | 1452 | 0.82 | 8.3 |
| M47V/I69F/A71D/V83I | 1168 | 76944 | 3.71 | 15906 | 9.8.3 | 3399 | 1.92 | 4.8 |
| E35D/T57A/A71D/L85Q | 1169 | 85724 | 4.13 | 3383 | 2.09 | 1764 | 0.99 | 25.3 |
| H18Y/A26T/E35D/A71D/L85Q | 1170 | 70878 | 3.42 | 6487 | 4.01 | 8026 | 4.53 | 10.9 |
| E35D/M47L | 1171 | 82410 | 3.97 | 11508 | 7.11 | 58645 | 33.08 | 7.2 |
| E23D/M42V/M43I/I58V/L70R | 1172 | 37331 | 1.80 | 10910 | 6.74 | 2251 | 1.27 | 3.4 |
| V68M/L70M/A71D/E95K | 1173 | 56479 | 2.72 | 10541 | 6.51 | 38182 | 21.53 | 5.4 |
| N55I/T57I/I69F | 1174 | 2855 | 0.14 | 1901 | 1.17 | 14759 | 8.32 | 1.5 |
| E35D/M43I/A71D | 1175 | 63789 | 3.08 | 6369 | 3.94 | 27290 | 15.39 | 10.0 |
| T41S/T57I/L70R | 1176 | 59844 | 2.89 | 4902 | 3.03 | 19527 | 11.01 | 12.2 |
| H18Y/A71D/L72P/E88V | 1177 | 68391 | 3.30 | 8862 | 5.48 | 1085 | 0.61 | 7.7 |
| V20I/A71D | 1178 | 60323 | 2.91 | 10500 | 6.49 | 3551 | 2.00 | 5.7 |
| E23G/A26S/E35D/T62N/A71D/L72V/L85M | 1179 | 59025 | 2.85 | 5484 | 3.39 | 10662 | 6.01 | 10.8 |
| A12T/E24D/E35D/D46V/I61V/L72P/E95V | 1180 | 63738 | 3.07 | 7411 | 4.58 | 1221 | 0.69 | 8.6 |
| V22L/E35D/M43L/A71G/D76H | 1181 | 2970 | 0.14 | 1498 | 0.93 | 1851 | 1.04 | 2.0 |
| E35G/K54E/A71D/L72P | 1182 | 71899 | 3.47 | 3697 | 2.29 | 1575 | 0.89 | 19.4 |
| L70Q/A71D | 1183 | 45012 | 2.17 | 18615 | 11.50 | 1692 | 0.95 | 2.4 |
| A26E/E35D/M47L/L85Q | 1184 | 40325 | 1.94 | 2266 | 1.40 | 55548 | 31.33 | 17.8 |
| D46E/A71D | 1185 | 69674 | 3.36 | 16770 | 10.36 | 22777 | 12.85 | 4.2 |
| Y31H/E35D/T41S/V68L/K93R/R94W | 1186 | 3379 | 0.16 | 2446 | 1.51 | 18863 | 10.64 | 1.4 |
| WT CD80 IgV Fc | 2039 | 20739 | 1.00 | 1618 | 1.00 | 1773 | 1.00 | 12.8 |
| WT CD80 ECD Fc | — | 72506 | 3.50 | 3072 | 1.90 | 4418 | 2.49 | 23.6 |

TABLE 13A

Variant CD155 selected against cognate binding partners. Molecule sequences, binding data, and costimulatory bioactivity data.

| CD155 mutations | SEQ ID NO (IgV) | CD226 tfxn MFI (CD226 MFI parental | TIGIT tfxn MFI (TIGIT MFI parental ratio) | CD96 MFI (CD96 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|---|
| P18S, P64S, F91S | 388 | 497825 (133.7) | 247219 (91.1) | 140065 (45.4) | 3528 (1.2) | 270.1 (0.7) |
| P18S, F91S, L104P | 389 | 26210 (7.0) | 75176 (27.7) | 10867 (3.5) | 2130 (0.7) | 364.2 (0.9) |
| L44P | 390 | 581289 (156.1) | 261931 (96.5) | 152252 (49.4) | 3414 (1.2) | 277.6 (0.7) |
| A56V | 391 | 455297 (122.3) | 280265 (103.2) | 161162 (52.2) | 2601 (0.9) | 548.2 (1.4) |
| P18L, L79V, F91S | 392 | 5135 (1.4) | 4073 (1.5) | 3279 (1.1) | 2719 (0.9) | 1241.5 (3.2) |
| P18S, F91S | 393 | 408623 (109.8) | 284190 (104.7) | 147463 (47.8) | 3348 (1.1) | 760.6 (2.0) |
| P18T, F91S | 394 | 401283 (107.8) | 223985 (82.5) | 157644 (51.1) | 3065 (1.1) | 814.7 (2.1) |
| P18T, S42P, F91S | 395 | 554105 (148.8) | 223887 (82.5) | 135395 (43.9) | 3796 (1.3) | 539.7 (1.4) |
| G7E, P18T, Y30C, F91S | 396 | 12903 (3.5) | 12984 (4.8) | 7906 (2.6) | 2671 (0.9) | 275.9 (0.7) |
| P18T, F91S, G111D | 397 | 438327 (117.7) | 287315 (105.8) | 167583 (54.3) | 4012 (1.4) | 307.2 (0.8) |
| P18S, F91P | 398 | 4154 (1.1) | 3220 (1.2) | 2678 (0.9) | 2816 (1.0) | 365.7 (0.9) |
| P18T, F91S, F108L | 399 | 394546 (106.0) | 298680 (110.0) | 193122 (62.6) | 2926 (1.0) | 775.4 (2.0) |
| P18T, T45A, F91S | 400 | 435847 (117.1) | 222044 (81.8) | 191026 (61.9) | 2948 (1.0) | 1546.8 (4.0) |
| P18T, F91S, R94H | 401 | 3589 (1.0) | 2942 (1.1) | 2509 (0.8) | 2390 (0.8) | 1273.2 (3.3) |
| P18S, Y30C, F91S | 402 | 382352 (102.7) | 276358 (101.8) | 56934 (18.5) | 3540 (1.2) | 426.5 (1.1) |
| A81V, L83P | 403 | 4169 (1.1) | 2912 (1.1) | 2616 (0.8) | 2993 (1.0) | 339.7 (0.9) |
| L88P | 404 | 65120 (17.5) | 74845 (27.6) | 35280 (11.4) | 2140 (0.7) | 969.2 (2.5) |
| Wild type | 387 | 3723 (1.0) | 2715 (1.0) | 3085 (1.0) | 2913 (1.0) | 389.6 (1.0) |
| R94H | 405 | 18905 (5.1) | 104013 (38.3) | 11727 (3.8) | 1663 (0.6) | 372.6 (1.0) |
| A13E, P18S, A56V, F91S | 406 | 357808 (96.1) | 179060 (66.0) | 118570 (38.4) | 2844 (1.0) | 349.2 (0.9) |
| P18T, F91S, V115A | 407 | 38487 (10.3) | 46313 (17.1) | 22718 (7.4) | 2070 (0.7) | 1574.5 (4.0) |
| P18T, Q60K | 408 | 238266 (64.0) | 173730 (64.0) | 154448 (50.1) | 4778 (1.6) | 427.2 (1.1) |

TABLE 13B

Additional CD155 Variants and Binding Data.

| CD155 Mutation(s) | SEQ ID NO (IgV) | TIGIT MFI at 100 nM | TIGIT Fold ↑ to WT ECD | CD226 MFI at 100 nM | CD226 Fold ↑ to WT ECD | CD112R MFI at 100 nM | CD112R Fold ↑ to WT ECD | CD96 MFI at 100 nM | CD96 Fold ↑ to WT ECD |
|---|---|---|---|---|---|---|---|---|---|
| S52M | 603 | 1865.3 | 0.00 | 1901.0 | 0.01 | 1553.4 | 0.87 | 1609.8 | 0.02 |
| T45Q, S52L, L104E, G111R | 604 | 2287.0 | 0.01 | 2390.4 | 0.01 | 1735.1 | 0.97 | 1575.1 | 0.02 |
| S42G | 605 | 4837.5 | 0.01 | 2448.1 | 0.01 | 1815.4 | 1.02 | 1699.6 | 0.02 |
| Q62F | 606 | 2209.5 | 0.01 | 2572.1 | 0.01 | 2706.5 | 1.52 | 2760.7 | 0.03 |
| S52Q | 607 | 2288.1 | 0.01 | 2022.3 | 0.01 | 1790.1 | 1.00 | 1822.3 | 0.02 |
| S42A, L104Q, G111R | 608 | 1923.7 | 0.00 | 1901.7 | 0.01 | 1815.1 | 1.02 | 1703.8 | 0.02 |
| S42A, S52Q, L104Q, G111R | 609 | 1807.5 | 0.00 | 2157.2 | 0.01 | 1894.4 | 1.06 | 1644.0 | 0.02 |
| S52W, L104E | 610 | 1938.2 | 0.00 | 1905.6 | 0.01 | 2070.6 | 1.16 | 1629.5 | 0.02 |
| S42C | 611 | 1914.0 | 0.00 | 2096.1 | 0.01 | 1685.0 | 0.95 | 1592.4 | 0.02 |
| S52W | 612 | 1991.6 | 0.00 | 2037.3 | 0.01 | 1612.8 | 0.90 | 1712.9 | 0.02 |
| S52M, L104Q | 613 | 2666.6 | 0.01 | 2252.2 | 0.01 | 1706.0 | 0.96 | 1633.1 | 0.02 |
| S42L, S52L, Q62F, L104Q | 614 | 2021.4 | 0.00 | 2643.8 | 0.02 | 1730.1 | 0.97 | 2318.7 | 0.02 |
| S42W | 615 | 2434.5 | 0.01 | 2133.4 | 0.01 | 2325.7 | 1.30 | 2555.4 | 0.03 |
| S42Q | 616 | 2073.5 | 0.00 | 2225.9 | 0.01 | 1905.1 | 1.07 | 2143.1 | 0.02 |
| S52L | 617 | 2224.8 | 0.01 | 2676.3 | 0.02 | 2038.6 | 1.14 | 2043.2 | 0.02 |
| S52R | 618 | 4395.4 | 0.01 | 3964.4 | 0.02 | 2741.7 | 1.54 | 4846.9 | 0.05 |
| L104E | 619 | 3135.4 | 0.01 | 2264.2 | 0.01 | 1803.5 | 1.01 | 1556.7 | 0.02 |
| G111R | 620 | 2082.7 | 0.00 | 2791.3 | 0.02 | 2470.9 | 1.39 | 3317.1 | 0.03 |
| S52E | 621 | 2655.4 | 0.01 | 2599.8 | 0.02 | 1904.9 | 1.07 | 1799.0 | 0.02 |
| Q62Y | 622 | 2528.6 | 0.01 | 2621.4 | 0.02 | 1918.4 | 1.08 | 1827.5 | 0.02 |
| T45Q, S52M, L104E | 623 | 79498.2 | 0.19 | 143238.5 | 0.83 | 2600.6 | 1.46 | 6310.4 | 0.06 |
| S42N, L104Q, G111R | 624 | 2432.1 | 0.01 | 2311.3 | 0.01 | 1847.4 | 1.04 | 1958.3 | 0.02 |

TABLE 13B-continued

Additional CD155 Variants and Binding Data.

| CD155 Mutation(s) | SEQ ID NO (IgV) | TIGIT MFI at 100 nM | TIGIT Fold ↑ to WT ECD | CD226 MFI at 100 nM | CD226 Fold ↑ to WT ECD | CD112R MFI at 100 nM | CD112R Fold ↑ to WT ECD | CD96 MFI at 100 nM | CD96 Fold ↑ to WT ECD |
|---|---|---|---|---|---|---|---|---|---|
| S52M, V57L | 625 | 1760.7 | 0.00 | 2431.6 | 0.01 | 2006.9 | 1.13 | 1858.7 | 0.02 |
| S42N, S52Q, Q62F | 626 | 2402.7 | 0.01 | 2152.0 | 0.01 | 1855.0 | 1.04 | 1737.6 | 0.02 |
| S42A, S52L, L104E, G111R | 627 | 2262.7 | 0.01 | 1889.4 | 0.01 | 1783.2 | 1.00 | 1606.2 | 0.02 |
| S42W, S52Q, V57L, Q62Y | 628 | 1961.4 | 0.00 | 2138.3 | 0.01 | 1844.9 | 1.03 | 1699.6 | 0.02 |
| L104Q | 629 | 10314.4 | 0.02 | 3791.4 | 0.02 | 2119.9 | 1.19 | 1542.6 | 0.02 |
| S42L, S52Q, L104E | 630 | 1946.9 | 0.00 | 6474.3 | 0.04 | 1749.0 | 0.98 | 1702.2 | 0.02 |
| S42C, S52L | 631 | 1762.5 | 0.00 | 2147.3 | 0.01 | 1663.4 | 0.93 | 1484.7 | 0.01 |
| S42W, S52R, Q62Y, L104Q | 632 | 1918.8 | 0.00 | 2300.1 | 0.01 | 1824.6 | 1.02 | 1756.0 | 0.02 |
| T45Q, S52R, L104E | 633 | 121636.9 | 0.29 | 142381.2 | 0.82 | 2617.9 | 1.47 | 3748.2 | 0.04 |
| S52R, Q62F, L104Q, G111R | 634 | 2969.2 | 0.01 | 3171.6 | 0.02 | 1725.4 | 0.97 | 2362.3 | 0.02 |
| T45Q, S52L, V57L, L104E | 635 | 2857.7 | 0.01 | 5943.5 | 0.03 | 1496.8 | 0.84 | 1533.3 | 0.02 |
| S52M, Q62Y | 636 | 1926.6 | 0.00 | 2000.3 | 0.01 | 1771.6 | 0.99 | 1651.1 | 0.02 |
| Q62F, L104E, G111R | 637 | 1966.4 | 0.00 | 2043.5 | 0.01 | 1701.9 | 0.95 | 1524.8 | 0.02 |
| T45Q, S52Q | 638 | 4812.8 | 0.01 | 5787.5 | 0.03 | 1765.6 | 0.99 | 2451.3 | 0.02 |
| S52L, L104E | 639 | 4317.8 | 0.01 | 2213.9 | 0.01 | 1756.9 | 0.99 | 1829.3 | 0.02 |
| S42V, S52E | 640 | 2055.0 | 0.01 | 2272.6 | 0.01 | 1808.0 | 1.01 | 2530.2 | 0.03 |
| T45Q, S52R, G111R | 641 | 4092.3 | 0.01 | 2075.2 | 0.01 | 1793.6 | 1.01 | 2336.6 | 0.02 |
| S42G, S52Q, L104E, G111R | 642 | 2010.1 | 0.00 | 2019.2 | 0.01 | 1706.4 | 0.96 | 1707.6 | 0.02 |
| S42N, S52E, V57L, L104E | 643 | 1784.2 | 0.00 | 1743.6 | 0.01 | 1690.1 | 0.95 | 1538.7 | 0.02 |
| Wildtype | 387 | 1964.7 | 0.00 | 2317.1 | 0.01 | 2169.6 | 1.22 | 1893.4 | 0.02 |
| S42C, S52M, Q62F | 644 | 1861.0 | 0.00 | 2084.2 | 0.01 | 1592.3 | 0.89 | 1481.3 | 0.01 |
| S42L | 645 | 1930.4 | 0.00 | 2187.2 | 0.01 | 1743.2 | 0.98 | 1618.4 | 0.02 |
| Wildtype | 387 | 2182.6 | 0.01 | 2374.5 | 0.01 | 1743.1 | 0.98 | 1680.4 | 0.02 |
| S42A | 646 | 1929.2 | 0.00 | 2188.6 | 0.01 | 1733.7 | 0.97 | 1623.6 | 0.02 |
| S42G, S52L, Q62F, L104Q | 647 | 1924.3 | 0.00 | 2157.6 | 0.01 | 1661.3 | 0.93 | 1642.1 | 0.02 |
| S42N | 648 | 1817.4 | 0.00 | 1910.9 | 0.01 | 1699.7 | 0.95 | 1691.5 | 0.02 |
| CD155 IgV Fc Wildtype | 387 | 4690 | 0.01 | 4690 | 0.03 | 2941 | 1.65 | 3272 | 0.03 |
| CD155 ECD-Fc | 47 (ECD) | 423797 | 1.00 | 172839 | 1.00 | 1783 | 1.00 | 99037 | 1.00 |
| Anti-human Fc PE | — | 1506.3 | 0.00 | 3774 | 0.02 | 1587 | 0.89 | 1618 | 0.02 |

TABLE 13C

Additional C155 Variants and Binding Data.

| CD155 Mutation(s) | SEQ ID NO (IgV) | TIGIT MFI at 100 nM | TIGIT Fold Increase to WT ECD | CD226 MFI at 100 nM | CD226 Fold Increase to WT ECD | CD96 MFI at 100 nM | CD96 Fold Increase to WT ECD |
|---|---|---|---|---|---|---|---|
| P18T, S65A, S67V, F91S | 649 | 297843 | 1.99 | 351195 | 3.22 | 128180 | 1.68 |
| P18F, T39A, T45Q, T61R, S65N, S67L, E73G, R78G | 650 | Little to no protein produced | | | | | |
| P18T, T45Q, T61R, S65N, S67L | 651 | 224682 | 1.50 | 270175 | 2.48 | 22820 | 0.30 |
| P18F, S65A, S67V, F91S | 652 | 534106 | 3.57 | 350410 | 3.21 | 144069 | 1.89 |
| P18F, T45Q, T61R, S65N, S67L, F91S, L104P | 653 | Little to no protein produced | | | | | |
| P18S, L79P, L104M | 654 | 342549 | 2.29 | 320823 | 2.94 | 107532 | 1.41 |
| P18S, L104M | 655 | 449066 | 3.00 | 295126 | 2.70 | 121266 | 1.59 |

TABLE 13C-continued

Additional C155 Variants and Binding Data.

| CD155 Mutation(s) | SEQ ID NO (IgV) | TIGIT MFI at 100 nM | TIGIT Fold Increase to WT ECD | CD226 MFI at 100 nM | CD226 Fold Increase to WT ECD | CD96 MFI at 100 nM | CD96 Fold Increase to WT ECD |
|---|---|---|---|---|---|---|---|
| L79P, L104M | 656 | 3210 | 0.02 | 8323 | 0.08 | 2894 | 0.04 |
| P18T, T45Q, L79P | 657 | 542878 | 3.63 | 371498 | 3.40 | 193719 | 2.55 |
| P18T, T45Q, T61R, S65H, S67H | 658 | 312337 | 2.09 | 225439 | 2.07 | 152903 | 2.01 |
| P18T, A81E | 659 | Little to no protein produced | | | | | |
| P18S, D23Y, E37P, S52G, Q62M, G80S, A81P, G99Y, S112N | 660 | Little to no protein produced | | | | | |
| A13R, D23Y, E37P, S42P, Q62Y, A81E | 661 | 4161 | 0.03 | 11673 | 0.11 | 5762 | 0.08 |
| A13R, D23Y, E37P, G99Y, S112N | 662 | Little to no protein produced | | | | | |
| A13R, D23Y, E37P, Q62M, A77V, G80S, A81P, G99Y | 663 | Little to no protein produced | | | | | |
| P18L, E37S, Q62M, G80S, A81P, G99Y, S112N | 664 | 5900 | 0.04 | 14642 | 0.13 | 3345 | 0.04 |
| P18S, L104T | 665 | 321741 | 2.15 | 367470 | 3.37 | 108569 | 1.43 |
| P18S, Q62H, L79Q, F91S | 666 | 283357 | 1.89 | 324877 | 2.98 | 125541 | 1.65 |
| P18S, F91S | 393 | 222780 | 1.49 | 300049 | 2.75 | 48542 | 0.64 |
| T45Q, S52K, Q62F, L104Q, G111R | 667 | Little to no protein produced | | | | | |
| T45Q, S52Q, Q62Y, L104Q, G111R | 668 | Little to no protein produced | | | | | |
| T45Q, S52Q, Q62Y, L104E, G111R | 669 | Little to no protein produced | | | | | |
| V57A, T61M, S65W, S67A, E96D, L104T | 670 | Little to no protein produced | | | | | |
| P18L, V57T, T61S, S65Y, S67A, L104T | 671 | 278178 | 1.86 | 276870 | 2.54 | 121499 | 1.60 |
| P18T, T45Q | 672 | 326769 | 2.18 | 357515 | 3.28 | 92389 | 1.21 |
| P18L, V57A, T61M, S65W, S67A, L104T | 673 | Little to no protein produced | | | | | |
| T61M, S65W, S67A, L104T | 674 | 360915 | 2.41 | 417897 | 3.83 | 148954 | 1.96 |
| P18S, V41A, S42G, T45G, L104N | 675 | 3821 | 0.03 | 11449 | 0.10 | 3087 | 0.04 |
| P18H, S42G, T45I, S52T, G53R, S54H, V57L, H59E, T61S, S65D, E68G, L104N | 676 | 5066 | 0.03 | 177351 | 1.63 | 3700 | 0.05 |
| P18S, S42G, T45V, F58L, S67W, L104N | 677 | 14137 | 0.09 | 15175 | 0.14 | 15324 | 0.20 |
| P18S, T45I, L104N | 678 | 141745 | 0.95 | 298011 | 2.73 | 97246 | 1.28 |
| P18S, S42G, T45G, L104N, V106A | 679 | 29387 | 0.20 | 117965 | 1.08 | 15884 | 0.21 |
| P18H, H40R, S42G, T45I, S52T, G53R, S54H, V57L, H59E, T61S, S65D, E68G, L104Y, V106L, F108H | 680 | 12335 | 0.08 | 14657 | 0.13 | 15779 | 0.21 |
| E37V, S42G, T45G, L104N | 681 | Little to no protein produced | | | | | |
| P18S, T45Q, L79P, L104T | 682 | 206674 | 1.38 | 285512 | 2.62 | 87790 | 1.15 |
| P18L, Q62R | 683 | 66939 | 0.45 | 25063 | 0.23 | 10928 | 0.14 |
| A13R, D23Y, E37P, S42L, S52G, Q62Y, A81E | 684 | Little to no protein produced | | | | | |
| P18L, H49R, L104T, D116N | 685 | 167980 | 1.12 | 214677 | 1.97 | 62451 | 0.82 |
| A13R, D23Y, E37P, Q62M, G80S, A81P, L104T | 686 | Little to no protein produced | | | | | |
| S65T, L104T | 687 | 205942 | 1.38 | 187147 | 1.71 | 65207 | 0.86 |
| A13R, D23Y, E37P, S52G, V57A, Q62M, K70E, L104T | 688 | Little to no protein produced | | | | | |
| P18L, A47V, Q62Y, E73D, L104T | 689 | 146142 | 0.98 | 248926 | 2.28 | 73956 | 0.97 |
| H40T, V41M, A47V, S52Q, Q62L, S65T, E73R, D97G, E98S, L104T, D116N | 690 | Little to no protein produced | | | | | |
| P18L, S42P, T45Q, T61G, S65H, S67E, L104T, D116N | 691 | 153536 | 1.03 | 402503 | 3.69 | 53044 | 0.70 |
| P18S, H40T, V41M, A47V, S52Q, Q62L, S65T, E73R, L104M, V106A | 692 | Little to no protein produced | | | | | |
| H40T, V41M, A47V, S52Q, Q62L, S65T, E68G, E73R, D97G, E98S, L104T | 693 | Little to no protein produced | | | | | |

TABLE 13C-continued

Additional C155 Variants and Binding Data.

|  |  | TIGIT | | CD226 | | CD96 | |
|---|---|---|---|---|---|---|---|
| CD155 Mutation(s) | SEQ ID NO (IgV) | MFI at 100 nM | Fold Increase to WT ECD | MFI at 100 nM | Fold Increase to WT ECD | MFI at 100 nM | Fold Increase to WT ECD |
| T45Q, S52E, L104E | 694 | Little to no protein produced | | | | | |
| T45Q, S52E, Q62F, L104E | 695 | 132850 | 0.89 | 276434 | 2.53 | 14558 | 0.19 |
| Wildtype CD155 ECD-Fc | 47 (ECD) | 149692 | 1.00 | 109137 | 1.00 | 76083 | 1.00 |
| Anti-human Fc PE | — | 2287 | 0.02 | 4799 | 0.04 | 2061 | 0.03 |

15

TABLE 13D

Additional CD155 Variants and Binding Data.

|  |  | TIGIT | | CD226 | | CD96 | |
|---|---|---|---|---|---|---|---|
| CD155 Mutations | SEQ ID NO (IgV) | MFI at 100 nM | Fold Increase to WT IgV | MFI at 100 nM | Fold Increase to WT IgV | MFI at 100 nM | Fold Increase to WT IgV |
| P18F, T26M, L44V, Q62K, L79P, F91S, L104M, G111D | 696 | 117327 | 1.2 | 1613 | 0.1 | 1629 | 0.1 |
| P18S, T45S, T61K, S65W, S67A, F91S, G111R | 697 | 124936 | 1.3 | 2114 | 0.1 | 2223 | 0.1 |
| P18S, L79P, L104M, T107M | 698 | 110512 | 1.1 | 18337 | 0.9 | 22793 | 1.3 |
| P18S, S65W, S67A, M90V, V95A, L104Q, G111R | 696 | 101726 | 1.0 | 1605 | 0.1 | 2571 | 0.1 |
| Wildtype CD155-ECD | 47 (ECD) | 98935 | 1.0 | 20029 | 1.0 | 17410 | 1.0 |

TABLE 13E

Additional CD155 Variants and Binding Data.

|  |  | TIGIT | | CD226 | | CD96 | |
|---|---|---|---|---|---|---|---|
| CD155 Mutations | SEQ ID NO (IgV) | MFI at 11.1 nM | Fold Change from CD155-ECD | MFI at 11.1 nM | Fold Change from CD155-ECD | MFI at 11.1 nM | Fold Change from CD155-ECD |
| P18S, A47G, L79P, F91S, L104M, T107A, R113W | 1550 | 56,409 | 1.19 | 1,191 | 0.08 | 25,362 | 1.49 |
| P18T, D23G, S24A, N35D, H49L, L79P, F91S, L104M, G111R | 1551 | 128,536 | 2.72 | 987 | 0.06 | 3,497 | 0.20 |
| V9L, P18S, Q60R, V75L, L79P, R89K, F91S, L104E, G111R | 1552 | 125,329 | 2.65 | 986 | 0.06 | 959 | 0.06 |
| P18S, H49R, E73D, L79P, N85D, F91S, V95A, L104M, G111R | 1553 | Little to no protein produced | | | | | |
| V11A, P18S, L79P, F91S, L104M, G111R | 1554 | 48,246 | 1.02 | 974 | 0.06 | 923 | 0.05 |
| V11A, P18S, S54R, Q60P, Q62K, L79P, N85D, F91S, T107M | 1555 | 190,392 | 4.02 | 1,019 | 0.07 | 1,129 | 0.07 |
| P18T, S52P, S65A, S67V, L79P, F91S, L104M, G111R | 1556 | 121,611 | 2.57 | 986 | 0.06 | 16,507 | 0

TABLE 13E-continued

Additional CD155 Variants and Binding Data.

|  |  | TIGIT | | CD226 | | CD96 | |
|---|---|---|---|---|---|---|---|
| CD155 Mutations | SEQ ID NO (IgV) | MFI at 11.1 nM | Fold Change from CD155-ECD | MFI at 11.1 nM | Fold Change from CD155-ECD | MFI at 11.1 nM | Fold Change from CD155-ECD |
| D8G, P18S, M36I, V38A, H49Q, A76E, F91S, L104M, T107A, R113W | 1558 | 79,333 | 1.68 | 1,026 | 0.07 | 2,313 | 0.14 |
| P18S, S52P, S65A, S67V, L79P, F91S, L104M, T107S, R113W | 1559 | 23,766 | 0.50 | 1,004 | 0.07 | 1,080 | 0.06 |
| T15I, P18T, L79P, F91S, L104M, G111R | 1560 | 55,498 | 1.17 | 1,516 | 0.10 | 1,030 | 0.06 |
| P18F, T26M, L44V, Q62K, L79P, E82D, F91S, L104M, G111D | 1561 | 213,640 | 4.51 | 991 | 0.06 | 1,276 | 0.07 |
| P18T, E37G, G53R, Q62K, L79P, F91S, E98D, L104M, T107M | 1562 | 251,288 | 5.31 | 2,001 | 0.13 | 45,878 | 2.69 |
| P18L, K70E, L79P, F91S, V95A, G111R | 1563 | 62,608 | 1.32 | 1,117 | 0.07 | 973 | 0.06 |
| V9I, Q12K, P18F, S65A, S67V, L79P, L104T, G111R, S112I | 1564 | 81,932 | 1.73 | 803 | 0.05 | 68,295 | 4.00 |
| P18F, S65A, S67V, F91S, L104M, G111R | 1565 | 30,661 | 0.65 | 901 | 0.06 | 3,193 | 0.19 |
| V9I, V10I, P18S, F20S, T45A, L79P, F91S, L104M, F108Y, G111R, S112V | 1566 | 151,489 | 3.20 | 973 | 0.06 | 974 | 0.06 |
| V9L, P18L, L79P, M90I, F91S, T102S, L104M, G111R | 1567 | 155,279 | 3.28 | 910 | 0.06 | 10,568 | 0.62 |
| P18C, T26M, L44V, M55I, Q62K, L79P, F91S, L104M, T107M | 1568 | 137,521 | 2.91 | 973 | 0.06 | 111,085 | 6.51 |
| V9I, P18T, D23G, L79P, F91S, G111R | 1569 | 151,426 | 3.20 | 897 | 0.06 | 2,725 | 0.16 |
| P18F, L79P, M90L, F91S, V95A, L104M, G111R | 1570 | 125,639 | 2.66 | 917 | 0.06 | 3,939 | 0.23 |
| P18F, L79P, M90L, F91S, V95A, L104M, G111R | 1570 | 115,156 | 2.43 | 1,073 | 0.07 | 2,464 | 0.14 |
| P18T, M36T, S65A, S67E, L79Q, A81T, F91S, G111R | 1571 | 10,616 | 0.22 | 1,130 | 0.07 | 963 | 0.06 |
| V9L, P18T, Q62R, L79P, F91S, L104M, G111R | 1572 | 195,111 | 4.12 | 835 | 0.05 | 1,497 | 0.09 |
| CD155-ECD-Fc | 47 (ECD) | 47,319 | 1.00 | 15,421 | 1.00 | 17,067 | 1.00 |
| Fc Control | 1189 | 2,298 | 0.05 | 1,133 | 0.07 | 996 | 0.06 |

TABLE 13F

Additional CD155 Variants and Binding Data.

|  |  | TIGIT | | CD226 | | CD112R | | CD96 | |
|---|---|---|---|---|---|---|---|---|---|
| CD155 Mutations | SEQ ID NO (IgV) | MFI at 25 nM | Fold Change from CD155-ECD | MFI at 25 nM | Fold Change from CD155-ECD | MFI at 25 nM | Fold Change from CD155-ECD | MFI at 25 nM | Fold Change from CD155-ECD |
| P18T, G19D, M36T, S54N, L79P, L83Q, F91S, T107M, F108Y | 1691 | 905 | 0.02 | 748 | 0.02 | 1276 | 1.56 | 726 | 0.01 |
|

TABLE 13F-continued

Additional CD155 Variants and Binding Data.

| | | TIGIT | | CD226 | | CD112R | | CD96 | |
|---|---|---|---|---|---|---|---|---|---|
| CD155 Mutations | SEQ ID NO (IgV) | MFI at 25 nM | Fold Change from CD155-ECD | MFI at 25 nM | Fold Change from CD155-ECD | MFI at 25 nM | Fold Change from CD155-ECD | MFI at 25 nM | Fold Change from CD155-ECD |
| Q12H, P18T, L21S, G22S, V57A, Q62R, L79P, F91S, T107M | 1695 | 1084 | 0.02 | 687 | 0.02 | 876 | 1.07 | 818 | 0.02 |
| V9I, P18S, S24P, H49Q, F58Y, Q60R, Q62K, L79P, F91S, T107M | 1696 | 69926 | 1.60 | 1089 | 0.03 | 1026 | 1.26 | 43856 | 0.90 |
| P18T, W46C, H49R, S65A, S67V, A76T, L79P, S87T, L104M | 1697 | 918 | 0.02 | 640 | 0.02 | 803 | 0.98 | 717 | 0.01 |
| P18S, S42T, E51G, L79P, F91S, G92W, T107M | 1698 | 12630 | 0.29 | 707 | 0.02 | 857 | 1.05 | 1050 | 0.02 |
| P18S, S42T, E51G, L79P, F91S, G92W, T107M | 1698 | 7476 | 0.17 | 851 | 0.02 | 935 | 1.15 | 924 | 0.02 |
| V10F, T15S, P18L, R48Q, L79P, F91S, T107M, V115M | 1699 | 1168 | 0.03 | 792 | 0.02 | 901 | 1.10 | 998 | 0.02 |
| P18S, L21M, Y30F, N35D, R84W, F91S, T107M, D116G | 1700 | 1377 | 0.03 | 743 | 0.02 | 946 | 1.16 | 1033 | 0.02 |
| P18F, E51V, S54G, Q60R, L79Q, E82G, S87T, M90I, F91S, G92R, T107M | 1701 | 46090 | 1.05 | 15701 | 0.41 | 1012 | 1.24 | 61814 | 1.27 |
| Q16H, P18F, F91S, T107M | 1702 | Little to no protein produced | | | | | | | |
| P18T, D23G, Q60R, S67L, L79P, F91S, T107M, V115A | 1703 | 64091 | 1.47 | 30931 | 0.81 | 874 | 1.07 | 108875 | 2.24 |
| D8G, V9I, V11A, P18T, T26M, S52P, L79P, F91S, G92A, T107L, V115A | 1704 | 52508 | 1.20 | 9483 | 0.25 | 817 | 1.00 | 97770 | 2.01 |
| V9I, P18F, A47E, G50S, E68G, L79P, F91S, T107M | 1705 | 55167 | 1.26 | 54341 | 1.43 | 752 | 0.92 | 102115 | 2.10 |
| P18S, M55I, Q62K, S69P, L79P, F91S, T107M | 1706 | Little to no protein produced | | | | | | | |
| P18T, T39S, S52P, S54R, L79P, F91S, T107M | 1707 | 45927 | 1.05 | 744 | 0.02 | 1038 | 1.27 | 1225 | 0.03 |
| P18S, D23N, L79P, F91S, T107M, S114N | 1708 | Little to no protein produced | | | | | | | |
| P18S, P34S, E51V, L79P, F91S, G111R | 1709 | 7917 | 0.18 | 769 | 0.02 | 853 | 1.04 | 892 | 0.02 |
| P18S, H59N, V75A, L79P, A81T, F91S, L104M, T107M | 1710 | 800 | 0.02 | 676 | 0.02 | 915 | 1.12 | 759 | 0.02 |
| P18S, W46R, E68D, L79P, F91S, T107M, R113G | 1711 | 1359 | 0.03 | 717 | 0.02 | 798 | 0.98 | 737 | 0.02 |
| V9L, P18F, T45A, S65A, S67V, R78K, L79V, F91S, T107M, S114T | 1712 | 130274 | 2.98 | 153569 | 4.04 | 812 | 1.00 | 85605 | 1.76 |
| P18T, M55L, T61R, L79P, F91S, V106I, T107M | 1713 | 133399 | 3.05 | 1906 | 0.05 | 827 | 1.01 | 57927 | 1.19 |
| T15I, P18S, V33M, N35F, T39S, M55L, R78S, L79P, F91S, T107M | 1714 | 7550 | 0.17 | 1015 | 0.03 | 789 | 0.97 | 2709 | 0.06 |
| P18S, Q62K, K70E, L79P, F91S, G92E, R113W | 1715 | 1951 | 11173 | 0.26 | 691 | 0.02 | 735 | 0.90 | 0.04 |
| P18F, F20I, T26M, A47V, E51K, L79P, F91S | 1716 | 136088 | 3.11 | 54026 | 1.42 | 1401 | 1.72 | 96629 | 1.99 |
| P18T, D23A, Q60H, L79P, M90V, F91S, T107M | 1717 | 43795 | 1.00 | 98241 | 2.58 | 888 | 1.09 | 70891 | 1.46 |
| P18S, D23G, C29R, N35D, E37G, M55I, Q62K, S65A, S67G, R78G, L79P, F91S, L104M, T107M, Q110R | 1718 | 1599 | 0.04 | 1030 | 0.03 | 1115 | 1.37 | 1944 | 0.04 |
| A13E, P18S, M36R, Q62K, S67T, L79P, N85D, F91S, T107M | 1719 | Little to no protein produced | | | | | | | |
| V9I, P18T, H49R, L79P, N85D, F91S, L104T, T107M | 1720 | 46375 | 1.06 | 76851 | 2.02 | 794 | 0.97 | 80210 | 1.65 |
| V9A, P18F, T61S, Q62L, L79P, F91S, G111R | 1721 | 26109 | 0.60 | 891 | 0.02 | 825 | 1.01 | 2633 | 0.05 |

TABLE 13F-continued

Additional CD155 Variants and Binding Data.

| CD155 Mutations | SEQ ID NO (IgV) | TIGIT MFI at 25 nM | TIGIT Fold Change from CD155-ECD | CD226 MFI at 25 nM | CD226 Fold Change from CD155-ECD | CD112R MFI at 25 nM | CD112R Fold Change from CD155-ECD | CD96 MFI at 25 nM | CD96 Fold Change from CD155-ECD |
|---|---|---|---|---|---|---|---|---|---|
| D8E, P18T, T61A, L79P, F91S, T107M | 1722 | Little to no protein produced | | | | | | | |
| P18S, V41A, H49R, S54C, L79S, N85Y, L88P, F91S, L104M, T107M | 1723 | 1098 | 0.03 | 830 | 0.02 | 876 | 1.07 | 1678 | 0.03 |
| V11E, P18H, F20Y, V25E, N35S, H49R, L79P, F91S, T107M, G111R | 1724 | 979 | 0.02 | 846 | 0.02 | 844 | 1.03 | 928 | 0.02 |
| V11A, P18F, D23A, L79P, G80D, V95A, T107M | 1725 | 45249 | 1.04 | 913 | 0.02 | 830 | 1.02 | 33883 | 0.70 |
| P18S, K70R, L79P, F91S, G111R | 1726 | 16180 | 0.37 | 793 | 0.02 | 854 | 1.05 | 1182 | 0.02 |
| P18T, D23A, Q60H, L79P, M90V, F91S, T107M | 1717 | 175673 | 4.02 | 161958 | 4.26 | 879 | 1.08 | 50981 | 1.05 |
| V9L, V11M, P18S, N35S, S54G, Q62K, L79P, L104M, T107M, V115M | 1727 | 2999 | 0.07 | 2315 | 0.06 | 893 | 1.09 | 925 | 0.02 |
| V9L, P18Y, V25A, V38G, M55V, A77T, L79P, M90I, F91S, L104M | 1728 | 138011 | 3.16 | 26015 | 0.68 | 919 | 1.13 | 17970 | 0.37 |
| V10G, P18T, L72Q, L79P, F91S, T107M | 1729 | 4253 | 0.10 | 1584 | 0.04 | 863 | 1.06 | 3643 | 0.07 |
| P18S, H59R, A76G, R78S, L79P | 1730 | 130622 | 2.99 | 79435 | 2.09 | 1009 | 1.24 | 44493 | 0.91 |
| V9A, P18S, M36T, S65G, L79P, F91S, L104T, G111R, S112I | 1731 | 92503 | 2.12 | 989 | 0.03 | 886 | 1.09 | 7850 | 0.16 |
| P18T, S52A, V57A, Q60R, Q62K, S65C, L79P, F91T, N100Y, T107M | 1732 | 187338 | 4.29 | 10579 | 0.28 | 908 | 1.11 | 3791 | 0.08 |
| V11A, P18F, N35D, A47E, Q62K, L79P, F91S, G99D, T107M, S114N | 1733 | Little to no protein produced | | | | | | | |
| V11A, P18T, N35S, L79P, S87T, F91S | 1734 | 218660 | 5.00 | 273825 | 7.20 | 1269 | 1.56 | 69871 | 1.44 |
| V9D, V11M, Q12L, P18S, E37V, M55I, Q60R, K70Q, L79P, F91S, L104M, T107M | 1735 | 8693 | 0.20 | 790 | 0.02 | 852 | 1.04 | 1991 | 0.04 |
| T15S, P18S, Y30H, Q32L, Q62R, L79P, F91S, T107M | 1736 | 16213 | 0.37 | 2092 | 0.06 | 1056 | 1.29 | 6994 | 0.14 |
| CD155-ECD-Fc | 47 (ECD) | 43704 | 1.00 | 38032 | 1.00 | 816 | 1.00 | 48638 | 1.00 |
| CD112-IgV | 795 | 1289 | | 824 | | 17819 | | 1172 | 0.02 |

TABLE 14A

Variant CD112 selected against cognate binding partners. Molecule sequences, binding data, and costimulatory bioactivity data.

| CD112 mutation(s) | SEQ ID NO (IgV) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|---|
| WT CD112 | 795 | 210829 (1.00) | 1452 (1.00) | 265392 (1.00) | 1112 (1.00) | 676.6 (1.00) |
| Y33H, A112V, G117D | 796 | 12948 (0.06) | 1552 (1.07) | 1368 (0.01) | 1241 (1.12) | 164.8 (0.24) |
| V19A, Y33H, S64G, S80G, G98S, N106Y, A112V | 797 | 48356 (0.23) | 1709 (1.18) | 2831 (0.01) | 1098 (0.99) | |
| L32P, A112V | 798 | 191432 (0.91) | 1557 (1.07) | 11095 (0.04) | 1259 (1.13) | 390.4 (0.58) |

TABLE 14A-continued

Variant CD112 selected against cognate binding partners. Molecule sequences, binding data, and costimulatory bioactivity data.

| CD112 mutation(s) | SEQ ID NO (IgV) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|---|
| A95V, A112I | 799 | 238418 (1.13) | 1706 (1.17) | 51944 (0.20) | 1215 (1.09) | 282.5 (0.42) |
| P28S, A112V | 800 | 251116 (1.19) | 1985 (1.37) | 153382 (0.58) | 1189 (1.07) | 503.4 (0.74) |
| P27A, T38N, V101A, A112V | 801 | 255803 (1.21) | 2138 (1.47) | 222822 (0.84) | 1399 (1.26) | 240.7 (0.36) |
| S118F | 802 | 11356 (0.05) | 5857 (4.03) | 6938 (0.03) | 1270 (1.14) | 271.7 (0.40) |
| R12W, H48Y, F54S, S118F | 803 | 10940 (0.05) | 3474 (2.39) | 5161 (0.02) | 1069 (0.96) | |
| R12W, Q79R, S118F | 804 | 2339 (0.01) | 7370 (5.08) | 1880 (0.01) | 1338 (1.20) | 447.4 (0.66) |
| T113S, S118Y | 805 | 6212 (0.03) | 6823 (4.70) | 1554 (0.01) | 1214 (1.09) | 225.1 (0.33) |
| S118Y | 806 | 2921 (0.01) | 6535 (4.50) | 2003 (0.01) | 1463 (1.32) | 190.4 (0.28) |
| N106I, S118Y | 807 | 2750 (0.01) | 7729 (5.32) | 1815 (0.01) | 1222 (1.10) | 265.8 (0.39) |
| N106I, S118F | 808 | 1841 (0.01) | 9944 (6.85) | 1529 (0.01) | 1308 (1.18) | 437.9 (0.65) |
| A95T, L96P, S118Y | 809 | 2352 (0.01) | 4493 (3.09) | 1412 (0.01) | 1329 (1.19) | 292.4 (0.43) |
| Y33H, P67S, N106Y, A112V | 810 | 225015 (1.07) | 3259 (2.24) | 204434 (0.77) | 1296 (1.17) | 618.8 (0.91) |
| N106Y, A112V | 811 | 6036 (0.03) | 1974 (1.36) | 15334 (0.06) | 1108 (1.00) | 409.9 (0.61) |
| T18S, Y33H, A112V | 812 | 252647 (1.20) | 1347 (0.93) | 183181 (0.69) | 1412 (1.27) | 601.8 (0.89) |
| P9S, Y33H, N47S, A112V | 813 | 240467 (1.14) | 1418 (0.98) | 203608 (0.77) | 1361 (1.22) | 449.1 (0.66) |
| P42S, P67H, A112V | 814 | 204484 (0.97) | 1610 (1.11) | 188647 (0.71) | 1174 (1.06) | 530.6 (0.78) |
| P27L, L32P, P42S, A112V | 815 | 219883 (1.04) | 1963 (1.35) | 84319 (0.32) | 1900 (1.71) | 251.6 (0.37) |
| G98D, A112V | 816 | 4879 (0.02) | 2369 (1.63) | 6100 (0.02) | 1729 (1.55) | 387.0 (0.57) |
| Y33H, S35P, N106Y, A112V | 817 | 250724 (1.19) | 1715 (1.18) | 94373 (0.36) | 1495 (1.34) | 516.2 (0.76) |
| L32P, P42S, T100A, A112V | 818 | 242675 (1.15) | 1742 (1.20) | 202567 (0.76) | 1748 (1.57) | 435.3 (0.64) |
| P27S, P45S, N106I, A112V | 819 | 223557 (1.06) | 1799 (1.24) | 84836 (0.32) | 1574 (1.42) | 277.5 (0.41) |
| Y33H, N47K, A112V | 820 | 251339 (1.19) | 1525 (1.05) | 199601 (0.75) | 1325 (1.19) | 483.2 (0.71) |
| Y33H, N106Y, A112V | 821 | 297169 (1.41) | 1782 (1.23) | 258315 (0.97) | 1440 (1.30) | 485.4 (0.72) |
| K78R, D84G, A112V, F114S | 822 | 236662 (1.12) | 1638 (1.13) | 24850 (0.09) | 1345 (1.21) | 142.5 (0.21) |
| F54L, A112V | 823 | 14483 (0.07) | 1617 (1.11) | 2371 (0.01) | 1353 (1.22) | 352.8 (0.52) |
| Y33H, A112V | 824 | 98954 (0.47) | 1216 (0.84) | 1726 (0.01) | 1298 (1.17) | |
| A95V, A112V | 825 | 168521 (0.80) | 2021 (1.39) | 200789 (0.76) | 1459 (1.31) | 412.9 (0.61) |
| R12W, A112V | 826 | 135635 (0.64) | 1582 (1.09) | 23378 (0.09) | 1412 (1.27) | 165.8 (0.24) |
| A112V | 832 | 213576 (1.01) | 1986 (1.37) | 151900 (0.57) | 1409 (1.27) | 211.4 (0.31) |
| Y33H, A112V | 824 | 250667 (1.19) | 1628 (1.12) | 230578 (0.87) | 1216 (1.09) | 612.7 (0.91) |
| R12W, P27S, A112V | 827 | 3653 (0.02) | 1308 (0.90) | 9105 (0.03) | 1051 (0.94) | |
| Y33H, V51M, A112V | 828 | 218698 (1.04) | 1384 (0.95) | 195450 (0.74) | 1170 (1.05) | 709.4 (1.05) |
| Y33H, A112V, S118T | 829 | 219384 (1.04) | 1566 (1.08) | 192645 (0.73) | 1313 (1.18) | 396.3 (0.59) |

TABLE 14A-continued

Variant CD112 selected against cognate binding partners. Molecule sequences, binding data, and costimulatory bioactivity data.

| CD112 mutation(s) | SEQ ID NO (IgV) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|---|
| Y33H, V101A, A112V, P115S | 830 | 5605 (0.03) | 1582 (1.09) | 5079 (0.02) | 1197 (1.08) | |
| H24R, T38N, D43G, A112V | 831 | 227095 (1.08) | 1537 (1.06) | 229311 (0.86) | 1336 (1.20) | 858.6 (1.27) |
| A112V | 832 | 4056 (0.02) | 1356 (0.93) | 10365 (0.04) | 986 (0.89) | |
| P27A, A112V | 833 | 193537 (0.92) | 1531 (1.05) | 230708 (0.87) | 3084 (2.77) | 355.1 (0.52) |
| A112V, S118T | 834 | 233173 (1.11) | 1659 (1.14) | 121817 (0.46) | 845 (0.76) | 533.3 (0.79) |
| R12W, A112V, M122I | 835 | 235935 (1.12) | 1463 (1.01) | 217748 (0.82) | 1350 (1.21) | 528.0 (0.78) |
| Q83K, N106Y, A112V | 836 | 205948 (0.98) | 2042 (1.41) | 234958 (0.89) | 1551 (1.39) | 481.4 (0.71) |
| R12W, P27S, A112V, S118T | 837 | 11985 (0.06) | 2667 (1.84) | 12756 (0.05) | 1257 (1.13) | 334.4 (0.49) |
| P28S, Y33H, A112V | 838 | 4711 (0.02) | 1412 (0.97) | 3968 (0.01) | 955 (0.86) | |
| P27S, Q90R, A112V | 839 | 3295 (0.02) | 1338 (0.92) | 6755 (0.03) | 1048 (0.94) | |
| L15V, P27A, A112V, S118T | 840 | 209888 (1.00) | 1489 (1.03) | 84224 (0.32) | 1251 (1.13) | 512.3 0.76) |
| Y33H, N106Y, T108I, A112V | 841 | Not tested | | | | |
| Y33H, P56L, V75M, V101M, A112V | 842 | Not tested | | | | |

TABLE 14B

Additional CD112 Variants and Binding Data.

| | | TIGIT | | CD226 | | CD112R | | CD96 | |
|---|---|---|---|---|---|---|---|---|---|
| CD112 Mutation(s) | SEQ ID NO (IgV) | MFI at 100 nM | Fold Increase to WT IgV | MFI at 100 nM | Fold Increase to WT IgV | MFI at 100 nM | Fold Increase to WT IgV | MFI at 100 nM | Fold Increase to WT IgV |
| S118F | 802 | 1763 | 0.02 | 1645 | 0.08 | 2974 | 0.61 | 1659 | 0.19 |
| N47K, Q79R, S118F | 925 | 1738 | 0.02 | 1689 | 0.09 | 2637 | 0.54 | 1647 | 0.19 |
| Q40R, P60T, A112V, S118T | 926 | 4980 | 0.06 | 1608 | 0.08 | 2399 | 0.50 | 2724 | 0.32 |
| F114Y, S118F | 927 | 110506 | 1.34 | 7325 | 0.37 | 1502 | 0.31 | 1553 | 0.18 |
| N106I, S118Y | 807 | 1981 | 0.02 | 1700 | 0.09 | 2394 | 0.49 | 1582 | 0.19 |
| S118Y | 806 | 101296 | 1.23 | 9990 | 0.50 | 1429 | 0.30 | 1551 | 0.18 |
| Y33H, K78R, S118Y | 928 | 2276 | 0.03 | 2115 | 0.11 | 3429 | 0.71 | 2082 | 0.24 |
| N106I, S118F | 808 | 1875 | 0.02 | 1675 | 0.08 | 2365 | 0.49 | 1662 | 0.19 |
| R12W, A46T, K66M, Q79R, N106I, T113A, S118F | 929 | 3357 | 0.04 | 1808 | 0.09 | 1664 | 0.34 | 4057 | 0.48 |
| Y33H, A112V, S118F | 930 | 3376 | 0.04 | 2886 | 0.15 | 3574 | 0.74 | 3685 | 0.43 |
| R12W, Y33H, N106I, S118F | 931 | 100624 | 1.22 | 24513 | 1.24 | 1490 | 0.31 | 2060 | 0.24 |
| L15V, Q90R, S118F | 932 | 5791 | 0.07 | 4169 | 0.21 | 2752 | 0.57 | 4458 | 0.52 |
| N47K, D84G, N106I, S118Y | 933 | 3334 | 0.04 | 2819 | 0.14 | 2528 | 0.52 | 3498 | 0.41 |
| L32P, S118F | 934 | 3881 | 0.05 | 2506 | 0.13 | 2659 | 0.55 | 2518 | 0.29 |
| Y33H, Q79R, A112V, S118Y | 935 | Low to no protein produced | | | | | | | |
| T18A, N106I, S118T | 936 | 84035 | 1.02 | 10208 | 0.52 | 1585 | 0.33 | 1590 | 0.19 |

TABLE 14B-continued

Additional CD112 Variants and Binding Data.

| CD112 Mutation(s) | SEQ ID NO (IgV) | TIGIT MFI 100 nM | TIGIT Fold Increase to WT IgV | CD226 MFI at 100 nM | CD226 Fold Increase to WT IgV | CD112R MFI at 100 nM | CD112R Fold Increase to WT IgV | CD96 MFI at 100 nM | CD96 Fold Increase to WT IgV |
|---|---|---|---|---|---|---|---|---|---|
| L15V, Y33H, N106Y, A112V, S118F | 937 | Low to no protein produced | | | | | | | |
| V37M, S118F | 938 | 96986 | 1.18 | 2523 | 0.13 | 1985 | 0.41 | 1849 | 0.22 |
| N47K, A112V, S118Y | 939 | 1980 | 0.02 | 1859 | 0.09 | 2733 | 0.56 | 1825 | 0.21 |
| A46T, A112V | 940 | 4224 | 0.05 | 4685 | 0.24 | 3288 | 0.68 | 4273 | 0.50 |
| P28S, Y33H, N106I, S118Y | 941 | 6094 | 0.07 | 2181 | 0.11 | 1891 | 0.39 | 3021 | 0.35 |
| P30S, Y33H, N47K, V75M, Q79R, N106I, S118Y | 942 | 2247 | 0.03 | 2044 | 0.10 | 1796 | 0.37 | 2658 | 0.31 |
| V19A, N47K, N106Y, K116E, S118Y | 943 | 2504 | 0.03 | 2395 | 0.12 | 2174 | 0.45 | 2852 | 0.33 |
| Q79R, T85A, A112V, S118Y | 944 | 2192 | 0.03 | 1741 | 0.09 | 2367 | 0.49 | 1620 | 0.19 |
| Y33H, A112V | 824 | 20646 | 0.25 | 1465 | 0.07 | 1794 | 0.37 | 2589 | 0.30 |

TABLE 14B

Additional CD112 Variants and Binding Data.

| CD112 Mutation(s) | SEQ ID NO (IgV) | TIGIT MFI at 100 nM | TIGIT Fold Increase to WT IgV | CD226 MFI at 100 nM | CD226 Fold Increase to WT IgV | CD112R MFI at 100 nM | CD112R Fold Increase to WT IgV | CD96 MFI at 100 nM | CD96 Fold Increase to WT IgV |
|---|---|---|---|---|---|---|---|---|---|
| V101M, N106I, S118Y | 945 | 55274 | 0.67 | 6625 | 0.33 | 1357 | 0.28 | 1494 | 0.17 |
| Y33H, Q79R, N106I, A112V, S118T | 946 | 6095 | 0.07 | 1760 | 0.09 | 2393 | 0.49 | 3033 | 0.36 |
| Q79R, A112V | 947 | 1571 | 0.02 | 1490 | 0.08 | 2284 | 0.47 | 1326 | 0.16 |
| Y33H, A46T, Q79R, N106I, S118F | 948 | 90813 | 1.10 | 15626 | 0.79 | 1298 | 0.27 | 3571 | 0.42 |
| A112V, G121S | 949 | 95674 | 1.16 | 19992 | 1.01 | 1252 | 0.26 | 4005 | 0.47 |
| Y33H, Q79R, N106I, S118Y | 950 | 36246 | 0.44 | 2118 | 0.11 | 1970 | 0.41 | 3250 | 0.38 |
| Y33H, N106I, A112V | 951 | 47352 | 0.57 | 4217 | 0.21 | 2641 | 0.55 | 1488 | 0.17 |
| Y33H, A46T, V101M, A112V, S118T | 952 | 14413 | 0.17 | 1596 | 0.08 | 2335 | 0.48 | 1441 | 0.17 |
| L32P, L99M, N106I, S118F | 953 | 3056 | 0.04 | 1791 | 0.09 | 2210 | 0.46 | 2000 | 0.23 |
| L32P, T108A, S118F | 954 | 104685 | 1.27 | 4531 | 0.23 | 2308 | 0.48 | 1518 | 0.18 |
| A112V | 832 | 4937 | 0.06 | 1903 | 0.10 | 1646 | 0.34 | 3011 | 0.35 |
| R12W, Q79R, A112V | 955 | 55539 | 0.67 | 6918 | 0.35 | 1386 | 0.29 | 1740 | 0.20 |
| Y33H, N106Y, E110G, A112V | 956 | 2786 | 0.03 | 2517 | 0.13 | 1787 | 0.37 | 2023 | 0.24 |
| Y33H, N106I, S118Y | 957 | 1967 | 0.02 | 1579 | 0.08 | 2601 | 0.54 | 1517 | 0.18 |
| Q79R, S118F | 958 | 82055 | 1.00 | 7582 | 0.38 | 1298 | 0.27 | 1970 | 0.23 |
| Y33H, Q79R, G98D, V101M, A112V | 959 | 21940 | 0.27 | 1632 | 0.08 | 1141 | 0.24 | 18423 | 2.16 |
| N47K, T81S, V101M, A112V, S118F | 960 | 6889 | 0.08 | 1311 | 0.07 | 1303 | 0.27 | 1145 | 0.13 |

TABLE 14B-continued

Additional CD112 Variants and Binding Data.

| | | TIGIT | | CD226 | | CD112R | | CD96 | |
|---|---|---|---|---|---|---|---|---|---|
| CD112 Mutation(s) | SEQ ID NO (IgV) | MFI at 100 nM | Fold Increase to WT IgV | MFI at 100 nM | Fold Increase to WT IgV | MFI at 100 nM | Fold Increase to WT IgV | MFI at 100 nM | Fold Increase to WT IgV |
| G82S, S118Y | 961 | 4267 | 0.05 | 1938 | 0.10 | 2140 | 0.44 | 2812 | 0.33 |
| Y33H, A112V, S118Y | 962 | 14450 | 0.18 | 1532 | 0.08 | 2353 | 0.49 | 3004 | 0.35 |
| Y33H, N47K, Q79R, N106Y, A112V | 963 | 70440 | 0.85 | 3557 | 0.18 | 1447 | 0.30 | 1679 | 0.20 |
| Y33H, S118T | 964 | 113896 | 1.38 | 17724 | 0.89 | 1252 | 0.26 | 5001 | 0.59 |
| R12W, Y33H, Q79R, V101M, A112V | 965 | 3376 | 0.04 | 2727 | 0.14 | 2047 | 0.42 | 2339 | 0.27 |
| S118F | 802 | 2685 | 0.03 | 1864 | 0.09 | 2520 | 0.52 | 1566 | 0.18 |
| Wildtype CD112-IgV Fc | 795 | 82414 | 1.00 | 19803 | 1.00 | 4842 | 1.00 | 8541 | 1.00 |
| CD112 ECD-Fc | 48 (ECD) | 29157 | 0.35 | 8755 | 0.44 | 1107 | 0.23 | 1103 | 0.13 |
| Anti-hFc PE | — | 1383 | 0.02 | 1461 | 0.07 | 1358 | 0.28 | 1468 | 0.17 |

TABLE 14C

Additional CD112 Variants and Binding Data.

| | | TIGIT | | CD226 | | CD112R | | CD96 | |
|---|---|---|---|---|---|---|---|---|---|
| CD112 Mutation(s) | SEQ ID NO (IgV) | MFI 20 nM | Fold Increase to WT IgV | MFI at 20 nM | Fold Increase to WT IgV | MFI at 20 nM | Fold Increase to WT IgV | MFI at 20 nM | Fold Increase to WT IgV |
| N106I, S118Y | 807 | 1288 | 0.04 | 1334 | 0.12 | 6920 | 4.16 | 1102 | 0.44 |
| Y33H, Q83K, A112V, S118T | 1503 | 115690 | 3.31 | 10046 | 0.93 | 1128 | 0.68 | 2053 | 0.82 |
| R12W, Q79R, S118F | 804 | 1436 | 0.04 | 1296 | 0.12 | 6546 | 3.93 | 1046 | 0.42 |
| V29M, Y33H, N106I, S118F | 1504 | | | Not tested | | | | | |
| Y33H, A46T, A112V | 1505 | 111256 | 3.18 | 14974 | 1.39 | 1148 | 0.69 | 3333 | 1.34 |
| Y33H, Q79R, S118F | 1506 | 1483 | 0.04 | 1326 | 0.12 | 7425 | 4.46 | 1138 | 0.46 |
| Y33H, N47K, F74L, S118F | 1507 | 1338 | 0.04 | 1159 | 0.11 | 1516 | 0.91 | 1140 | 0.46 |
| R12W, V101M, N106I, S118Y | 1508 | 1378 | 0.04 | 1249 | 0.12 | 5980 | 3.59 | 1182 | 0.47 |
| A46T, V101A, N106I, S118Y | 1509 | 1359 | 0.04 | 1199 | 0.11 | 6729 | 4.04 | 1173 | 0.47 |
| Y33H, N106Y, A112V | 821 | 113580 | 3.25 | 17771 | 1.65 | 1207 | 0.72 | 2476 | 0.99 |
| N106Y, A112V, S118T | 1510 | | | Not tested | | | | | |
| S76P, T81I, V101M, N106Y, A112V, S118F | 1511 | | | Not tested | | | | | |
| N106Y, A112V | 811 | 29015 | 0.83 | 2760 | 0.26 | 1159 | 0.70 | 1639 | 0.66 |
| P9R, L21V, P22L, I34M, S69F, F74L, A87V, A112V, L125A | 5112 | 1920 | 0.05 | 1218 | 0.11 | 1107 | 0.66 | 1074 | 0.43 |
| Y33H, V101M, A112V | 1513 | 126266 | 3.61 | 24408 | 2.27 | 1150 | 0.69 | 4535 | 1.82 |
| N106I, S118F | 808 | 1776 | 0.05 | 1385 | 0.13 | 9058 | 5.44 | 1370 | 0.55 |
| V29A, L32P, S118F | 1514 | 1265 | 0.04 | 1148 | 0.11 | 5057 | 3.04 | 1194 | 0.48 |
| A112V | 832 | 69673 | 1.99 | 6387 | 0.59 | 1140 | 0.68 | 1214 | 0.49 |
| Y33H, V101M, A112V | 1513 | 133815 | 3.83 | 24992 | 2.32 | 1184 | 0.71 | 6338 | 2.54 |

TABLE 14C-continued

Additional CD112 Variants and Binding Data.

| CD112 Mutation(s) | SEQ ID NO (IgV) | TIGIT MFI at 20 nM | TIGIT Fold Increase to WT IgV | CD226 MFI at 20 nM | CD226 Fold Increase to WT IgV | CD112R MFI at 20 nM | CD112R Fold Increase to WT IgV | CD96 MFI at 20 nM | CD96 Fold Increase to WT IgV |
|---|---|---|---|---|---|---|---|---|---|
| P285, Y33H, N106I, S118Y | 941 | 2745 | 0.08 | 1689 | 0.16 | 6625 | 3.98 | 1978 | 0.79 |
| Y33H, V101M, N106I, A112V | 1515 | 118654 | 3.40 | 21828 | 2.03 | 1253 | 0.75 | 3871 | 1.55 |
| R12W, Y33H, N47K, Q79R, S118Y | 1516 | 171390 | 4.91 | 5077 | 0.47 | 1124 | 0.68 | 2636 | 1.06 |
| A112V, S118T | 834 | 103203 | 2.95 | 15076 | 1.40 | 1155 | 0.69 | 1426 | 0.57 |
| Y33H, A46T, A112V, S118T | 1517 | 141859 | 4.06 | 29436 | 2.74 | 1184 | 0.71 | 5760 | 2.31 |
| Y33H, A112V, F114L, S118I | 1518 | 5161 | 0.15 | 1734 | 0.16 | 1184 | 0.71 | 1249 | 0.50 |
| A112V | 832 | 78902 | 2.26 | 6224 | 0.58 | 1114 | 0.67 | 1181 | 0.47 |
| Y33H, T38A, A46T, V101M, A112V | 1519 | 111293 | 3.19 | 25702 | 2.39 | 1192 | 0.72 | 99015 | 39.69 |
| Q79R, A112V | 947 | 96674 | 2.77 | 7264 | 0.67 | 1130 | 0.68 | 1216 | 0.49 |
| Y33H, N106I, S118Y | 957 | 5720 | 0.16 | 1453 | 0.14 | 6543 | 3.93 | 1248 | 0.50 |
| P285, Y33H, S69P, N106I, A112V, S118Y | 1520 | 22393 | 0.64 | 1378 | 0.13 | 1550 | 0.93 | 19174 | 7.68 |
| Y33H, P42L, N47K, V101M, A112V | 1521 | 214116 | 6.13 | 13878 | 1.29 | 1315 | 0.79 | 4753 | 1.91 |
| Y33H, N47K, F745, Q83K, N106I, F111L, A112V, S118T | 1522 | 6719 | 0.19 | 1319 | 0.12 | 1305 | 0.78 | 1278 | 0.51 |
| Y33H, A112V, S118T, V119A | 1523 | 184794 | 5.29 | 10204 | 0.95 | 1269 | 0.76 | 4321 | 1.73 |
| Y33H, N106I, A112V, S118F | 1524 | 6872 | 0.20 | 1591 | 0.15 | 2308 | 1.39 | 2796 | 1.12 |
| Y33H, K66M, S118F, W124L | 1525 | 1724 | 0.05 | 1259 | 0.12 | 6782 | 4.07 | 1197 | 0.48 |
| S118F | 802 | 1325 | 0.04 | 1213 | 0.11 | 7029 | 4.22 | 1135 | 0.46 |
| N106I, A112V | 811 | 111342 | 3.19 | 4241 | 0.39 | 1546 | 0.93 | 1178 | 0.47 |
| Y33H, A112V | 824 | 177926 | 5.09 | 13761 | 1.28 | 1152 | 0.69 | 3117 | 1.25 |
| WT CD112 IgV | 795 | 34932 | 1.00 | 10762 | 1.00 | 1665 | 1.00 | 2495 | 1.00 |
| WT CD112-Fc ECD | 48 (ECD) | 28277 | 0.81 | 8023 | 0.75 | 1253 | 0.75 | 1064 | 0.43 |
| Anti-huFc PE | — | 1138 | 0.03 | 1006 | 0.09 | 1010 | 0.61 | 1062 | 0.43 |

TABLE 15A

Selected PD-L1 variants and binding data.

| PD-L1 Mutation(s) | SEQ ID NO (IgV) | Binding to Jurkat/PD-1 Cells MFI at 50 nM | Fold increase over wildtype PD-L1 IgV-Fc |
|---|---|---|---|
| K28N, M41V, N45T, H51N, K57E | 1389 | 12585 | 2.4 |
| I20L, I36T, N45D, I47T | 1390 | 3119 | 0.6 |
| I20L, M41K, K44E | 1391 | 9206 | 1.8 |
| P6S, N4ST, N78I, I83T | 1392 | 419 | 0.1 |
| N78I | 1393 | 2249 | 0.4 |
| M41K, N78I | 1394 | Little or no protein produced | |
| N17D, N45T, V50A, D72G | 1400 | Little or no protein produced | |
| I20L, F49S | 1401 | Little or no protein produced | |
| N45T, VS0A | 1402 | 23887 | 4.6 |
| I20L, N45T, N78I | 1403 | 29104 | 5.6 |
| N45T, N78I | 1395 | 24865 | 4.7 |
| I20L, N4ST | 1396 | 24279 | 4.6 |
| I20L, N45T, VS0A | 1404 | 34158 | 6.5 |
| N45T | 1397 | 6687 | 1.3 |

TABLE 15A-continued

| Selected PD-L1 variants and binding data. | | | |
|---|---|---|---|
| | | Binding to Jurkat/PD-1 Cells | |
| PD-L1 Mutation(s) | SEQ ID NO (IgV) | MFI at 50 nM | Fold increase over wildtype PD-L1 IgV-Fc |
| M41K | 1398 | 5079 | 1.0 |
| M41V, N45T | 1405 | Little or no protein produced | |
| M41K, N45T | 1406 | Little or no protein produced | |
| A33D, S75P, D85E | 1407 | 685 | 0.1 |
| M18I, M41K, D43G, H51R, N781 | 1408 | 20731 | 4.0 |
| V11E, 120L, I36T, N45D, H60R, S75P | 1409 | 3313 | 0.6 |
| A33D, V50A | 1410 | Little or no protein produced | |
| S16G, A33D, K71E, S75P | 1411 | Little or no protein produced | |
| E27G, N4ST, M97I | 1412 | 881 | 0.2 |
| E27G, N45T, K57R | 1413 | 5022 | 1.0 |
| A33D, E53V | 1414 | 650 | 0.1 |
| D43G, N45D, V58A | 1415 | 63960 | 12.2 |
| E40G, D43V, N45T, V50A | 1416 | 809 | 0.2 |
| Y14S, K28E, N45T | 1417 | 16232 | 3.1 |
| A33D, N78S | 1418 | 1725 | 0.3 |
| A33D, N781 | 1419 | 8482 | 1.6 |
| A33D, N45T | 1420 | 17220 | 3.3 |
| A33D,N45T, N78I | 1421 | Little or no protein produced | |
| E27G, N45T, V50A | 1422 | 25267 | 4.8 |
| N45T, V50A, N78S | 1423 | 28572 | 5.4 |
| N451, V50A | 1402 | 18717 | 3.6 |
| I20L, N45T, V110M | 1424 | 464 | 0.1 |
| I20L, I36T, N45T, V50A | 1425 | 7658 | 1.5 |
| N45T, L74P, S75P | 1426 | 5251 | 1.0 |
| N45T, S75P | 1427 | 12200 | 2.3 |
| S75P, K106R | 1428 | 388 | 0.1 |
| S75P | 1429 | 1230 | 0.2 |
| A33D, S75P | 1430 | 306 | 0.1 |
| A33D, S75P, D104G | 1431 | 251 | 0.0 |
| A33D, S75P | 1430 | 1786 | 0.3 |
| I20L, E27G, N45T, V50A | 1433 | 29843 | 5.7 |
| I20L, E27G, D43G, N45D, V58A, N78I | 1434 | 69486 | 13.3 |
| I20L, D43G, N45D, V58A, N78I | 1435 | 72738 | 13.9 |
| I20L, A33D, D43G, N45D, V58A, N78I | 1436 | 80205 | 15.3 |
| I20L, D43G, N45D, N78I | 1437 | 67018 | 12.8 |
| E27G, N45T, V50A, N78I | 1438 | 30677 | 5.9 |
| N45T, V50A, N78I | 1439 | 32165 | 6.1 |
| V11A, I20L, E27G, D43G, N45D, H51Y, S99G | 1440 | 73727 | 14.1 |
| I20L, E27G, D43G, N45T, V50A | 1441 | 36739 | 7.0 |
| I20L, K28E, D43G, N45D, V58A, Q89R, | 1442 | 80549 | 15.4 |
| I20L, I36T, N45D | 1443 | 16870 | 3.2 |
| I20L, K28E, D43G, N45D, E53G, V58A, N78I | 1444 | 139 | 0.0 |
| A33D, D43G, N45D, V58A, S75P | 1445 | 58484 | 11.2 |
| K23R, D43G, N45D | 1446 | 67559 | 12.9 |
| I20L, D43G, N45D, V58A, N78I, D90G, G101D | 1447 | 259 | 0.0 |
| D43G, N45D, L56Q, V58A, G101G-ins(G101GG) | 1448 | 88277 | 16.8 |
| I20L, K23E, D43G, N45D, V58A, N78I | 1449 | 89608 | 17.1 |
| I20L, K23E, D43G, N45D, V50A, N78I | 1450 | 88829 | 16.9 |
| T19I, E27G, N45I, V50A, N78I, M97K | 1451 | 25496 | 4.9 |
| 120L, M41K, D43G, N45D | 1452 | 599 | 0.1 |
| K23R, N45T, N78I | 1453 | 84980 | 16.2 |
| Full length PD-L1 Fc | — | 18465 | 3.5 |
| Wild type PD-L1 IgV | 1454 | 5243 | 1.0 |
| Anti-PD-1 monoclonal antibody (niVolumab) | — | 79787 | 15.2 |
| Human IgG | — | 198 | 0.0 |

TABLE 15B

Flow Binding to Cells Expressing PD-1 or CD80

| PD-L1 Mutation(s) | SEQ ID NO (ECD) | PD-1 MFI at 20 nM | PD-1 Fold Change Compared to WT PD-L1 | CD80 MFI at 20 nM | CD80 Fold Change Compared to WT PD-L1 |
|---|---|---|---|---|---|
| K57R, S99G | 1813 | 2953 | 0.9 | 16253 | 121.3 |
| K57R, S99G, F189L | 1814 | 1930 | 0.6 | 12906 | 96.3 |
| M18V, M97L, F193S, R195G, E200K, H202Q | 1815 | 69 | 0.0 | 241 | 1.8 |
| I36S, M41K, M97L, K144Q, R195G, E200K, H202Q, L206F | 1816 | 3498 | 1.1 | 68715 | 512.8 |
| C22R, Q65L, L124S, K144Q, R195G, E200N, H202Q, T221L | 1817 | Little or no protein produced | | | |
| M18V, I98L, L124S, P198T, L206F | 1818 | 2187 | 0.7 | 143 | 1.1 |
| S99G, N117S, I148V, K171R, R180S | 1819 | Little or no protein produced | | | |
| I36T, M97L, A103V, Q155H | 1820 | 120 | 0.0 | 128 | 1.0 |
| K28I, S99G | 1821 | 830 | 0.3 | 693 | 5.2 |
| R195S | 1822 | 3191 | 1.0 | 138 | 1.0 |
| A79T, S99G, T185A, R195G, E200K, H202Q, L206F | 1823 | 1963 | 0.6 | 643 | 4.8 |
| K57R, S99G, L124S, K144Q | 1824 | 2081 | 0.7 | 14106 | 105.3 |
| K57R, S99G, R195G | 1825 | 2479 | 0.8 | 10955 | 81.8 |
| D55V, M97L, S99G | 1826 | 11907 | 3.8 | 71242 | 531.7 |
| E27G, I36T, D55N, M97L, K111E | 1827 | 1904 | 0.6 | 88724 | 662.1 |
| E54G, M97L, S99G | 1828 | 8414 | 2.7 | 51905 | 387.4 |
| G15A, I36T, M97L, K111E, H202Q | 1829 | 112 | 0.0 | 13530 | 101.0 |
| G15A, I36T, V129D | 1830 | 114 | 0.0 | 136 | 1.0 |
| G15A, I36T, V129D, R195G | 1831 | 125 | 0.0 | 134 | 1.0 |
| G15A, V129D | 1832 | 2075 | 0.7 | 128 | 1.0 |
| I36S, M97L | 1833 | 3459 | 1.1 | 44551 | 332.5 |
| I36T, D55N, M97L, K111E, A204T | 1834 | 265 | 0.1 | 62697 | 467.9 |
| I36T, D55N, M97L, K111E, V129A, F173L | 1835 | 393 | 0.1 | 72641 | 542.1 |
| I36T, D55S, M97L, K111E, I148V, R180S | 1836 | 94 | 0.0 | 30704 | 229.1 |
| I36T, G52R, M97L, V112A, K144E, V175A, P198T | 1837 | 81 | 0.0 | 149 | 1.1 |
| I36T, I46V, D55G, M97L, K106E, K144E, T185A, R195G | 1838 | 69 | 0.0 | 190 | 1.4 |
| I36T, I83T, M97L, K144E, P198T | 1839 | 62 | 0.0 | 6216 | 46.4 |
| I36T, M97L, K111E | 1840 | Little or no protein produced | | | |
| I36T, M97L, K144E, P198T | 1841 | 197 | 0.1 | 40989 | 305.9 |
| I36T, M97L, Q155H, F193S, N201Y | 1842 | 69 | 0.0 | 1251 | 9.3 |
| I36T, M97L, V129D | 1843 | 523 | 0.2 | 50905 | 379.9 |
| L35P, I36S, M97L, K111E | 1844 | 190 | 0.1 | 155 | 1.2 |
| M18I, I36T, E53G, M97L, K144E, E199G, V207A | 1845 | 104 | 0.0 | 47358 | 353.4 |
| M18T, I36T, D55N, M97L, K111E | 1846 | 138 | 0.0 | 71440 | 533.1 |
| M18V, M97L, T176N, R195G | 1847 | 1301 | 0.4 | 45300 | 338.1 |
| M97L, S99G | 1848 | 12906 | 4.1 | 81630 | 609.2 |
| N17D, M97L, S99G | 1849 | 10079 | 3.2 | 73249 | 546.6 |
| S99G, T185A, R195G, P198T | 1850 | 2606 | 0.8 | 22062 | 164.6 |
| V129D, H202Q | 1851 | 2001 | 0.6 | 219 | 1.6 |
| V129D, P198T | 1852 | 3245 | 1.0 | 152 | 1.1 |
| V129D, T150A | 1853 | 1941 | 0.6 | 142 | 1.1 |
| V93E, V129D | 1854 | 1221 | 0.4 | 150 | 1.1 |
| Y10F, M18V, S99G, Q138R, T203A | 1855 | 70 | 0.0 | 412 | 3.1 |
| WT PD-L1 (IgV + IgC) Fc | 1812 | 3121 | 1.0 | 134 | 1.0 |
| CTLA4-Fc | — | 59 | N/A | 199670 | N/A |
| Anti-PD1 mAb | — | 31482 | N/A | 134 | N/A |
| Fc Control | 1189 | 59 | N/A | 132 | N/A |

TABLE 15C

Additional Affinity-Matured IgSF Domain-Containing Molecules

| PD-L1 Mutation(s) | SEQ ID NO (ECD) |
|---|---|
| N45D | 1945 |
| K160M, R195G | 1946 |
| N45D, K144E | 1947 |
| N45D, P198S | 1948 |
| N45D, P198T | 1949 |
| N45D, R195G | 1950 |
| N45D, R195S | 1951 |
| N45D, S131F | 1952 |
| N45D, V58D | 1953 |
| V129D, R195S | 1954 |
| I98T, F173Y, L196S | 1955 |
| N45D, E134G, L213P | 1956 |
| N45D, F173I, S177C | 1957 |
| N45D, I148V, R195G | 1958 |
| N45D, K111T, R195G | 1959 |
| N45D, N113Y, R195S | 1960 |
| N45D, N165Y, E170G | 1961 |
| N45D, Q89R, I98V | 1962 |
| N45D, S131F, P198S | 1963 |
| N45D, S75P, P198S | 1964 |
| N45D, V50A, R195T | 1965 |
| E27D, N45D, T183A, I188V | 1966 |
| F173Y, T183I, L196S, T203A | 1967 |
| K23N, N45D, S75P, N120S | 1968 |
| N45D, G102D, R194W, R195G | 1969 |
| N45D, G52V, Q121L, P198S | 1970 |
| N45D, I148V, R195G, N201D | 1971 |
| N45D, K111T, T183A, I188V | 1972 |
| N45D, Q89R, F189S, P198S | 1973 |
| N45D, S99G, C137R, V207A | 1974 |
| N45D, T163I, K167R, R195G | 1975 |
| N45D, T183A, T192S, R194G | 1976 |
| N45D, V50A, I119T, K144E | 1977 |
| T19A, N45D, K144E, R195G | 1978 |
| V11E, N45D, T130A, P198T | 1979 |
| V26A, N45D, T163I, T185A | 1980 |
| K23N, N45D, L124S, K167T, R195G | 1981 |
| K23N, N45D, Q73R, T163I | 1982 |
| K28E, N45D, W149R, S158G, P198T | 1983 |
| K28R, N45D, K57E, I98V, R195S | 1984 |
| K28R, N45D, V129D, T163N, R195T | 1985 |
| M41K, D43G, N45D, R64S, R195G | 1986 |
| M41K, D43G, N45D, R64S, S99G | 1987 |
| N45D, R68L, F173L, D197G, P198S | 1988 |
| N45D, V50A, I148V, R195G, N201D | 1989 |
| M41K, D43G, K44E, N45D, R195G, N201D | 1990 |
| N45D, V50A, L124S, K144E, L179P, R195G | 1991 |

Example 9

Generation of Stacked Molecules Containing Different Affinity-Modified Domains

This Example describes further immunomodulatory proteins that were generated as multi-domain stack constructs containing at least two different affinity modified IgV domains from identified variant PD-L2 polypeptides and identified variant CD155 polypeptides described above. Specifically, the exemplary variant PD-L2 IgV H15Q/T47A/K65R/S67L/Q82R/V89D (SEQ ID NO:328) and the exemplary variant CD155 IgV molecule P18S/S65W/S67A/L104Q/G111R (SEQ ID NO:1598) were linked together and fused to an Fc in various configurations. Stack constructs were obtained as geneblocks (Integrated DNA Technologies, Coralville, Iowa) that either encoded the entire chain or they were generated by obtaining geneblocks that encode PDL2-CD155 in its various configurations for subsequent Gibson assembly into Fc fusion vector using a Gibson assembly kit (New England Biolabs). Homodimeric and heterodimeric stacks were generated in various configurations as summarized in FIG. 5A and as follows.

Homodimeric stack constructs were generated containing identical Fc subunits in which the variant PD-L2 IgV and variant CD155 IgV were variously linked to the N- or C-terminus of a human IgG1 Fc region via a 2×GGGS (SEQ ID NO:264) or 3×GGGGS (SEQ ID NO: 263) peptide linker. In this study, the exemplary IgG1 Fc subunit is set forth in SEQ ID NO:1189 and contained the mutations L234A, L235E, G237A, E356D and M358L by EU numbering (corresponding to L19A, L20E, G22A, E141D and M143L with reference to wild-type human IgG1 Fc set forth in SEQ ID NO:211). Further, the Fc region contained replacement of the cysteine residues to a serine residue at position 5 (C5 S) compared to the wild-type or unmodified Fc set forth in SEQ ID NO: 211 (corresponding to C220S by EU numbering). In some examples, the exemplary IgG1 Fc set forth in SEQ ID NO: 1189 was used, which contained the above mutations and additionally lacked the C-terminal lysine corresponding to position 232 of the wild-type or unmodified Fc set forth in SEQ ID NO: 211 (corresponding to K447del by EU numbering). Other Fc regions also are suitable for generation of stack molecules. Exemplary generated stacks are set forth below.

The homodimeric variant IgV-stacked-Fc fusion molecules containing various configurations of variant IgV domains from PD-L2 (SEQ ID NO: 328) and CD155 (SEQ ID NO:1598) were expressed and purified substantially as described in Example 5.

The encoding nucleic acid molecule was designed to produce homodimeric stacks in various configurations of sequences in the order shown:

PD-L2/CD155 Stack 1 (SEQ ID NO: 1191): CD155 variant (SEQ ID NO: 1598) - 2xGGGS (SEQ ID NO: 264) -Fc (SEQ ID NO: 1189) - 3x GGGGS (SEQ ID NO: 263) - PD-L2 (SEQ ID NO: 328)

PD-L2/CD155 Stack 2 (SEQ ID NO: 1192): PD-L2 (SEQ ID NO: 328) - 2xGGGS (SEQ ID NO: 264) -Fc (SEQ ID NO: 1189) - 3x GGGGS (SEQ ID NO: 263) - CD155 variant (SEQ ID NO: 1598)

PD-L2/CD155 Stack 3 (SEQ ID NO: 1193): CD155 variant (SEQ ID NO: 1598) -3x GGGGS (SEQ ID NO: 263) - PD-L2 (SEQ ID NO: 328) - 2xGGGS (SEQ ID NO: 264) -Fc (SEQ ID NO: 1189)

-continued

PD-L2/CD155 Stack 4 (SEQ ID NO: 1194): PD-L2 (SEQ ID NO: 328) - 3x GGGGS (SEQ ID NO: 263) - CD155 variant (SEQ ID NO: 1598) - 2xGGGS (SEQ ID NO: 264) -Fc (SEQ ID NO: 1189)

PD-L2/CD155 Stack 5 (SEQ ID NO: 1195): Fc (SEQ ID NO: 1189) - 3x GGGGS (SEQ ID NO: 263) - CD155 variant (SEQ ID NO: 1598) - 3xGGGS (SEQ ID NO: 263) - PD-L2 (SEQ ID NO: 328)

PD-L2/CD155 Stack 6 (SEQ ID NO: 1196): Fc (SEQ ID NO: 1189) - 3x GGGGS (SEQ ID NO: 263) - PD-L2 (SEQ ID NO: 328) - 3xGGGS (SEQ ID NO: 263) - CD155 variant (SEQ ID NO: 1598)

Heterodimeric stacks were generated in two ways. The first way was by co-expression of the variant PD-L2 IgV and/or variant CD155 IgV fused to (1) a first "knob" Fc subunit (set forth in SEQ ID NO:1187 containing the mutations S354C and T366W by EU numbering, corresponding to S139C and T151W with reference to wild-type human IgG1 Fc set forth in SEQ ID NO:211); and (2) a second "hole" Fc subunit (set forth in SEQ ID NO:1188, containing the mutations Y349C, T366S, L368A and Y407V by EU numbering, corresponding to Y134C, T151S, L153A and Y192V with reference to wild-type human IgG1 Fc set forth in SEQ ID NO:211) for expression of a heterodimeric molecule by "knobs-into-hole" engineering. In addition, both the knob and hole Fc also contained mutations L19A, L20E, G22A to reduce effector function and contained replacement of the cysteine residue to a serine residue at position 5 (C5 S), each compared to the wild-type or unmodified Fc set forth in SEQ ID NO: 211 (corresponding to C220S, L234A, L235E and G237A by EU numbering, respectively). In a second way, PDL2 and/or CD155 were fused to both knob and hole Fc's to generate stacks where each chain consists of Fc with fused IgV domain(s). For constructs in which the Fc sequence was the N-terminal portion of the sequence, a stuffer sequence HMSSVSAQ (SEQ ID NO:1190) was added immediately preceding the Fc sequence.

The heterodimeric variant IgV-stacked-Fc fusion molecules containing various configurations of variant IgV domains from PD-L2 (SEQ ID NO: 328) and CD155 (SEQ ID NO:1598) were expressed and purified substantially as described in Example 5. For each stack, the encoding nucleic acid molecule of the knob and hole were designed to produce heterodimeric stacks in various configurations with sequences in the order shown:

PD-L2/CD155 Stack 7 containing (1) knob Fc fusion (SEQ ID NO: 1197): CD155 variant (SEQ ID NO: 1598) - 2xGGGS (SEQ ID NO: 264) - knob Fc (SEQ ID NO: 1187) - 3x GGGGS (SEQ ID NO: 263) - PD-L2 (SEQ ID NO: 328)
and (2) hole Fc (SEQ ID NO: 1188 plus N-terminal HMSSVSAQ set forth in SEQ ID NO: 1190)

PD-L2/CD155 Stack 8 containing (1) knob Fc fusion (SEQ ID NO: 1198): PD-L2 (SEQ ID NO: 328) - 2xGGGS (SEQ ID NO: 264) - knob Fc (SEQ ID NO: 1187) - 3x GGGGS (SEQ ID NO: 263) - CD155 variant (SEQ ID NO: 1598)

and (2) hole Fc (SEQ ID NO: 1188 plus N-terminal HMSSVSAQ set forth in SEQ ID NO: 1190)

PD-L2/CD155 Stack 9 containing (1) knob Fc fusion (SEQ ID NO: 1199): CD155 variant (SEQ ID NO: 1598) - 3x GGGGS (SEQ ID NO: 263) - CD155 variant (SEQ ID NO: 1598) - 2xGGGS (SEQ ID NO: 264) - knob Fc (SEQ ID NO: 1187) - 3x GGGGS (SEQ ID NO: 263) - PD-L2 (SEQ ID NO: 328) - 3x GGGGS (SEQ ID NO: 263) - PD-L2 (SEQ ID NO: 328);

and (2) hole Fc (SEQ ID NO: 1188 plus N-terminal HMSSVSAQ set forth in SEQ ID NO: 1190)

PD-L2/CD155 Stack 10 containing (1) knob Fc fusion (SEQ ID NO: 1200): PD-L2 (SEQ ID NO: 328) - 3x GGGGS (SEQ ID NO: 263) - PD-L2 (SEQ ID NO: 328) - 2xGGGS (SEQ ID NO: 264) - knob Fc (SEQ ID NO: 1187) - 3x GGGGS (SEQ ID NO: 263) - CD155 variant (SEQ ID NO: 1598) - 3x GGGGS (SEQ ID NO: 263) - CD155 variant (SEQ ID NO: 1598);

and (2) hole Fc (SEQ ID NO: 1188 plus N-terminal HMSSVSAQ set forth in SEQ ID NO: 1190)

PD-L2/CD155 Stack 11 containing (1) knob fc fusion (SEQ ID NO: 1201): CD155 variant (SEQ ID NO: 1598) - 3x GGGGS (SEQ ID NO: 263) - CD155 variant (SEQ ID NO: 1598) - 2xGGGS (SEQ ID NO: 264) -knob Fc (SEQ ID NO: 1187);

and

-continued (2) hole Fc fusion (SEQ ID NO: 1202): PD-L2 (SEQ ID NO: 328) - 3x GGGGS (SEQ ID NO: 263) - PD-L2 (SEQ ID NO: 328) - 2xGGGS (SEQ ID NO: 264) - hole Fc (SEQ ID NO: 1188)

PD-L2/CD155 Stack 12 containing (1) knob fc fusion (SEQ ID NO: 1203): knob Fc (SEQ ID NO: 1187 plus N-terminal HMSSVSAQ set forth in SEQ ID NO: 1190) - 3x GGGGS (SEQ ID NO: 263) - CD155 variant (SEQ ID NO: 1598) - 3x GGGGS (SEQ ID NO: 263) CD155 variant (SEQ ID NO: 1598);

and (2) hole Fc (SEQ ID NO: 1204): hole Fc (SEQ ID NO: 1188 plus N-terminal HMSSVSAQ set forth in SEQ ID NO: 1190) - 3x GGGGS (SEQ ID NO: 263) - PD-L2 (SEQ ID NO: 328) - 3x GGGGS (SEQ ID NO: 263) - PD-L2 (SEQ ID NO: 328)

PD-L2/CD155 Stack 13 containing (1) knob Fc fusion (SEQ ID NO: 1199): CD155 variant (SEQ ID NO: 1598) - 3x GGGGS (SEQ ID NO: 263) - CD155 variant (SEQ ID NO: 1598) - 2xGGGS (SEQ ID NO: 264) - knob Fc (SEQ ID NO: 1187) - 3x GGGGS (SEQ ID NO: 263) - PD-L2 (SEQ ID NO: 328) - 3x GGGGS (SEQ ID NO: 263) - PD-L2 (SEQ ID NO: 328);

and (2) hole Fc (SEQ ID NO: 1204): hole Fc (SEQ ID NO: 1188 plus N-terminal HMSSVSAQ set forth in SEQ ID NO: 1190) - 3x GGGGS (SEQ ID NO: 263) - PD-L2 (SEQ ID NO: 328) - 3x GGGGS (SEQ ID NO: 263) - PD-L2 (SEQ ID NO: 328)

PD-L2/CD155 Stack 14 containing (1) knob Fc fusion (SEQ ID NO: 1199): CD155 variant (SEQ ID NO: 1598) - 3x GGGGS (SEQ ID NO: 263) - CD155 variant (SEQ ID NO: 1598) - 2xGGGS (SEQ ID NO: 264) - knob Fc (SEQ ID NO: 1187) - 3x GGGGS (SEQ ID NO: 263) - PD-L2 (SEQ ID NO: 328) - 3x GGGGS (SEQ ID NO: 263) - PD-L2 (SEQ ID NO: 328);

and (2) hole Fc fusion (SEQ ID NO: 1202): PD-L2 (SEQ ID NO: 328) - 3x GGGGS (SEQ ID NO: 263) - PD-L2 (SEQ ID NO: 328) - 2xGGGS (SEQ ID NO: 264) - hole Fc (SEQ ID NO: 1188)

PD-L2/CD155 Stack 15 containing (1) knob Fc fusion (SEQ ID NO: 1200): PD-L2 (SEQ ID NO: 328) - 3x GGGGS (SEQ ID NO: 263) - PD-L2 (SEQ ID NO: 328) - 2xGGGS (SEQ ID NO: 264) - knob Fc (SEQ ID NO: 1187) - 3x GGGGS (SEQ ID NO: 263) - CD155 variant (SEQ ID NO: 1598) - 3x GGGGS (SEQ ID NO: 263) - CD155 variant (SEQ ID NO: 1598);

and (2) hole Fc fusion (SEQ ID NO: 1202): PD-L2 (SEQ ID NO: 328) - 3x GGGGS (SEQ ID NO: 263) - PD-L2 (SEQ ID NO: 328) 2xGGGS (SEQ ID NO: 264) - hole Fc (SEQ ID NO: 1188)

PD-L2/CD155 Stack 16 containing (1) knob Fc fusion (SEQ ID NO: 1200): PD-L2 (SEQ ID NO: 328) - 3x GGGGS (SEQ ID NO: 263) - PD-L2 (SEQ ID NO: 328) - 2xGGGS (SEQ ID NO: 264) - knob Fc (SEQ ID NO: 1187) - 3x GGGGS (SEQ ID NO: 263) - CD155 variant (SEQ ID NO: 1598) - 3x GGGGS (SEQ ID NO: 263) - CD155 variant (SEQ ID NO: 1598);

and (2) hole Fc (SEQ ID NO: 1204): hole Fc (SEQ ID NO: 1188 plus N-terminal HMSSVSAQ set forth in SEQ ID NO: 1190) - 3x GGGGS (SEQ ID NO: 263) - PD-L2 (SEQ ID NO: 328) - 3x GGGGS (SEQ ID NO: 263) - PD-L2 (SEQ ID NO: 328)

Example 10

Generation of Secreted Immunomodulatory Protein

To generate a PD-L2 secreted immunomodulatory protein (SIP), DNA encoding exemplary SIPs was obtained as gene blocks from Integrated DNA Technologies (Coralville, USA) and then cloned by Gibson assembly (New England Biolabs Gibson assembly kit) into a modified version of pRRL vector (Dull et al., (1998) J Virol, 72(11): 8463-8471) between restriction sites downstream of MND promoter to remove GFP. Exemplary SIP constructs were generated to encode a protein set forth in SEQ ID NO: 1254-1257, including the signal peptide. In this exemplary Example, the constructs were generated to additionally include a tag moiety. The gene blocks had the following structure in order: 39 base pair overlap with pRRL prior to first restriction site-first restriction site-GCCGCCACC (Kozak); complete ORF encoding PD-L2 IgV wildtype amino acid sequence set forth in SEQ ID NO:115 or variant PD-L2 IgV set forth in SEQ ID NO:316 (H15Q,V31M,S67L,Q82R, V89D), SEQ ID NO:328 (H15Q,T47A,K65R,S67L,Q82R, V89D) or SEQ ID NO: 342 (H15Q,T47A,S67L,R76G, Q82R,V89D), also including in all cases the PD-L2 signal peptide MIFLLLMLSLELQLHQIAA as set forth in SEQ ID NO: 1251; DNA encoding Avitag as set forth in SEQ ID NO:1252 (GLNDIFEAQKIEWHE); DNA encoding His tag as set forth in SEQ ID NO: 1253 (HHHHHH); TAA stop codon; second restriction site-41 base pair overlap with pRRL beyond second restriction site.

To prepare lentiviral vectors, $3 \times 10^6$ HEK293 cells were plated per 100 mm dish. On the next day, 4.5 µg of P-Mix (3 µg of PAX2 and 1.5 µg of pMD2G) was added to 6 µg of DNA encoding the SIPs constructs in a 5 mL polypropylene tube. Diluent buffer (10 mM HEPES/150 mM NaCl pH7.05/1 L TC grade H20) was added to the tube to bring up the total volume of 500 µL. To the diluent DNA (PEI:total DNA 4:1), 424, of PEI (1 µg/µL) was added and mixed by vortexing. The mixture was incubated at room temperature for 10 minutes and cells were prepared by aspirating medium from the dish gently without disturbing the adherent cells, then replaced with 6 mL of Opti-MEM(1×). DNA/PEI mixture was then added to the dish and incubated at 37° C. for 24 hours. After 24 hours, media was aspirated from the dishes and replaced with 10 mL of fresh DMEM media and then incubated at 37° C. Viral supernatant was collected after 48 hours using a syringe attached to a 0.45 µm filter PES to remove cells and debris from the culture (Thermo Scientific Nalgene Syringe Filter). A separate lentiviral vector stock also was prepared encoding an anti-CD19 CAR (containing an anti-CD19 scFv, a hinge and transmembrane domain derived from CD8 and a CD3zeta signaling domain) substantially as described. The exemplary anti-CD19 CAR used is set forth in SEQ ID NO: 2024 (encoded by the sequence in set forth in SEQ ID NO: 2025) containing the scFv set forth in SEQ ID NO:1211, the CD8-derived hinge and transmembrane domain set forth in SEQ ID NO: 266, and the CD3zeta set forth in SEQ ID NO:267

Pan T-cells were transduced with the viral vectors encoding the PD-L2 SIPs. T-cells were thawed and activated with anti-CD3/anti-CD28 beads (Dynal) at a 1:1 ratio. The T-cells ($1 \times 10^6$ cells) were mixed with 1 mL total lentiviral vector supernatant containing equal volume (0.5 mL each) of the lentiviral vector supernatant encoding the indicated PD-L2 SIPs and a A. Binding to Cell-Expressed Counter Structure Binding studies were carried out using Jurkat/IL-2 reporter cells (purchased from Promega Corp. USA) that were transduced to stably express human PD-1 (Jurkat/PD-1 cells), human TIGIT (Jurkat/TIGIT cells) or both PD-1 and TIGIT (Jurkat/PD-1/TIGIT cells). For staining by flow cytometry, 100,000 Jurkat/PD-1, Jurkat/TIGIT, Jurkat/PD-1/TIGIT cells or negative control (Jurkat only) were plated in 96-well round-bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 µL staining buffer containing 100 nM to 46 pM of each candidate Fc fusion protein. Primary staining was performed on ice for 90 minutes, before washing cells twice in 200 µL staining buffer. PE-conjugated anti-human Fc (Jackson ImmunoResearch, USA) was diluted 1:150 in 50 µL staining buffer and added to cells and incubated another 30 minutes on ice. Secondary antibody was washed out twice, cells were fixed in 4% formaldehyde/PBS, and samples were analyzed on Intellicyt flow cytometer (Intellicyt Corp., USA).

Mean Fluorescence Intensity (MFI) was calculated with FlowJo Version 10 software (FlowJo LLC, USA). Table 16 sets forth binding activity as measured by the Mean Fluorescence Intensity (MFI) value for binding of 6.25 nM of each stack Fc-fusion molecule to Jurkat/PD-1, Jurkat/TIGIT, and Jurkat/PD-1/TIGIT cells. As shown in Table 16, several stack proteins bind both PD-1 and TIGIT with high affinity.

TABLE 16

Binding of PD-L2/CD155 Stacks to Cell-Expressed Counter Structure

| Category | Description | SEQ ID NO | Binding to Jurkat Transfectants MFI at 6.25 nM | | |
|---|---|---|---|---|---|
| | | | PD1 | TIGIT | TIGIT + PD1 |
| Homodimers | (CD155 IgV)—(G4S)2—Fc—(G4S)3 (PD-L2 IgV) | 1191 | 242 | 19948 | 5336 |
| | (PD-L2 IgV) (G4S)2 Fc (G4S)3 (CD155 IgV) | 1192 | 16344 | 9095 | 16458 |
| | (CD155 IgV) (G4S)3 (PD-L2 IgV) (G4S)2 Fc | 1193 | 91 | 22342 | 8135 |
| | (PD-L2 IgV) (G4S)3 (CD155 IgV) (G4S)2 Fc | 1194 | 9218 | 14516 | 19256 |
| | Fc (G4S)3 (CD155 IgV) (G4S)3 (PD-L2 IgV) | 1195 | 108 | 5486 | 2905 |
| | Fc (G4S)3 (PD-L2 IgV) (G4S)3 (CD155 IgV) | 1196 | 66 | 9974 | 5202 |
| Heterodimers | (CD155 IgV) (G4S)2 knob Fc—(G4S)3 (PD-L2 IgV) and hole Fc | 1197 + 1188 | 107 | 2544 | 1512 |
| | (PD-L2 IgV) (G4S)2 knob Fc (G4S)3 (CD155 IgV) and hole Fc | 1198 + 1188 | 1658 | 360 | 6762 |
| | (CD155 IgV) (G4S)3 (CD155 IgV) (G4S)2 knob Fc (G4S)3 (PD-L2 IgV) (G4S)3 (PD-L2 IgV) and hole Fc | 1199 + 1188 | 289 | 8677 | 4371 |
| | (PD-L2 IgV) (G4S)3 (PD-L2 IgV) (G4S)2 knob Fc (G4S)3 (CD155 IgV) (G4S)3 (CD155 IgV) and hole Fc | 1200 + 1188 | 1594 | 2554 | 5509 |
| | (CD155 IgV) (G4S)3 (CD155 IgV) (G4S)2 knob Fc and (PD-L2 IgV) (G4S)3 (PD-L2 IgV) (G4S)2 hole Fc | 1201 + 1202 | 1758 | 9642 | 9343 |
| | (CD155 IgV) (G4S)3 (CD155 IgV) (G4S)2 knob Fc (G4S)3 (PD-L2 IgV) (G4S)3 (PD-L2 IgV) and (PD-L2 IgV) (G4S)3 (PD-L2 IgV) (G4S)2 hole Fc | 1199 + 1202 | 4821 | 7596 | 8081 |
| | (CD155 IgV) (G4S)3 (CD155 IgV) (G4S)2 knob Fc (G4S)3 (PD-L2 IgV) (G4S)3 (PD-L2 IgV) and hole Fc (G4S)3 (PD-L2 IgV) (G4S)3 (PD-L2 IgV) | 1199 + 1204 | 515 | 8299 | 4228 |
| | (PD-L2 IgV) (G4S)3 (PD-L2 IgV) (G4S)2 knob Fc (G4S)3 (CD155 IgV) (G4S)3 (CD155 IgV) and (PD-L2 IgV) (G4S)3 (PD-L2 IgV) (G4S)2 hole Fc | 1200 + 1202 | 10970 | 3339 | 9014 |
| | (PD-L2 IgV) (G4S)3 (PD-L2 IgV) (G4S)2 knob Fc (G4S)3 (CD155 IgV) (G4S)3 (CD155 IgV) and hole Fc (G4S)3 (PD-L2 IgV) (G4S)3 (PD-L2 IgV) | 1200 + 1204 | 3785 | 1475 | 5989 |
| Controls | PDL2-IgV | 328 | 22448 | 73 | 20280 |
| | CD155-IgV | 1598 | 133 | 22342 | 4893 |
| | Fc Control (homodimer) | 1189 | 44 | 86 | 66 |
| | Fc Control (heterodimer) | 1187 + 1188 | 42 | 48 | 48 |

TABLE 16-continued

Binding of PD-L2/CD155 Stacks to Cell-Expressed Counter Structure

| Category | Description | SEQ ID NO | Binding to Jurkat Transfectants MFI at 6.25 nM | | |
|---|---|---|---|---|---|
| | | | PD1 | TIGIT | TIGIT + PD1 |
| | Wild Type CD155 full ECD Fc | 20 (ECD) | 64 | 4547 | 249 |
| | Wild Type PD-L2 full ECD Fc | 4 (ECD) | 392 | 46 | 314 |
| | Irrelevant Ig Control | hIgG | 41 | 48 | 41 |

B. Assessment of Bioactivity of Affinity-Matured IgSF Domain-Containing Molecules Using Mixed Lymphocyte Reaction (MLR)

Soluble PD-L2/CD155 stack protein bioactivity was tested in a human Mixed Lymphocyte Reaction (MLR). Human primary dendritic cells (DC) were generated by culturing monocytes isolated from PBMC (BenTech Bio, USA) in vitro for 7 days with 50 ng/mL rIL-4 (R&D Systems, USA) and 80 ng/mL rGM-CSF (R&D Systems, USA) in Ex-Vivo 15 media (Lonza, Switzerland). To induce DC maturation, lipopolysaccharide (LPS) (InvivoGen Corp., USA) was added to the DC cultures on day 6 and cells were incubated for an additional 24 hours. Approximately 10,000 matured DC and 100,000 purified allogeneic CD3+ T cells (BenTech Bio, USA) were co-cultured with several concentrations of PD-L2/CD155 stack or control proteins in 96 well round-bottom plates in 200 μL final volume of Ex-Vivo 15 media. Irrelevant human IgG and homodimeric and heterodimeric empty Fc proteins were used as negative controls. As positive controls, PD-L2-Fc (full PD-L2 extracellular domain), wildtype CD155-Fc (full CD155 extracellular domain) were assessed. Variant PD-L2 IgV-Fc fusion proteins were tested at 20 nM. On day 5, IFN-gamma secretion in culture supernatants was analyzed using the Human IFN-gamma Duoset ELISA kit (R&D Systems, USA). Optical density was measured on a BioTek Cytation Multimode Microplate Reader (BioTek Corp., USA) and quantitated against titrated rIFN-gamma standard included in the IFN-gamma Duo-set kit (R&D Systems, USA).

Results for the bioactivity studies for exemplary tested PD-L2/CD155 stack proteins are summarized in Table 17, which sets forth the calculated levels of IFN-gamma in culture supernatants (pg/mL). The sequence identifier (SEQ ID NO) for each stack proteins is set forth in column 3. As shown in Table 17, culture supernatants incubated in the presence of exemplary PD-L2/CD155 stack proteins exhibited altered levels of IFNg production in the MLR assay.

TABLE 17

Bioactivity Data of PD-L2/CD155 Stacks

| Category | Description | SEQ ID NO | Mixed Lymphocyte Reaction: IFNg at 96 hours | |
|---|---|---|---|---|
| | | | IFNg [pg/mL] | Fold Increase compared to IgG Control |
| Homodimers | (CD155 IgV) (G4S)2 Fc (G4S)3 (PD-L2 IgV) | 1191 | 3097.0 | 1.3 |
| | (PD-L2 IgV) (G4S)2 Fc (G4S)3 (CD155 IgV) | 1192 | 3700.3 | 1.6 |
| | (CD155 IgV) (G4S)3 (PD-L2 IgV) (G4S)2 Fc | 1193 | 3061.6 | 1.3 |
| | (PD-L2 IgV) (G4S)3 (CD155 IgV) (G4S)2 Fc | 1194 | 2270.0 | 1.0 |
| | Fc (G4S)3 (CD155 IgV) (G4S)3 (PD-L2 IgV) | 1195 | 2003.5 | 0.9 |
| | Fc (G4S)3 (PD-L2 IgV) (G4S)3 (CD155 IgV) | 1196 | 2951.0 | 1.3 |
| Heterodimers | (CD155 IgV)—(G4S)2 knobFc (G4S)3 (PD-L2 IgV) and hole Fc | 1197 + 1188 | 2040.4 | 0.9 |
| | (PD-L2 IgV) (G4S)2 knob Fc (G4S)3— (CD155 IgV) and hole Fc | 1198 + 1188 | 3768.6 | 1.6 |
| | (CD155 IgV)—(G4S)3 (CD155 IgV) (G4S)2 knob Fc (G4S)3 (PD-L2 IgV) (G4S)3 (PD-L2 IgV) and hole Fc | 1199 + 1188 | 3549.7 | 1.5 |
| | (PD-L2 IgV) (G4S)3—(PD-L2 IgV) (G4S)2 knob Fc (G4S)3 (CD155 IgV) (G4S)3 (CD155 IgV) and hole Fc | 1200 + 1188 | 2568.6 | 1.1 |
| | (CD155 IgV) (G4S)3 (CD155 IgV) (G4S)2 knob Fc and (PD-L2 IgV) (G4S)3 (PD-L2 IgV) (G4S)2 hole Fc | 1201 + 1202 | 2572.1 | 1.1 |

TABLE 17-continued

Bioactivity Data of PD-L2/CD155 Stacks

| Category | Description | SEQ ID NO | Mixed Lymphocyte Reaction: IFNg at 96 hours | |
|---|---|---|---|---|
| | | | IFNg [pg/mL] | Fold Increase compared to IgG Control |
| | (CD155 IgV)—(G4S)3 (CD155 IgV) (G4S)2 knob Fc (G4S)3 (PD-L2 IgV)—(G4S)3 (PD-L2 IgV) and (PD-L2 IgV)—(G4S)3 (PD-L2 IgV) (G4S)2 hole Fc | 1199 + 1202 | 3216.7 | 1.4 |
| | (CD155 IgV)—(G4S)3 (CD155 IgV) (G4S)2 knob Fc (G4S)3 (PD-L2 IgV)—(G4S)3 (PD-L2 IgV) and hole Fc (G4S)3 (PD-L2 IgV) (G4S)3 (PD-L2 IgV) | 1199 + 1204 | 2673.4 | 1.2 |
| | (PD-L2 IgV) (G4S)3—(PD-L2 IgV) (G4S)2 knob Fc (G4S)3 (CD155 IgV) (G4S)3 (CD155 IgV) and (PD-L2 IgV) (G4S)3 (PD-L2 IgV) (G4S)2—hole Fc | 1200 + 1202 | 2361.6 | 1.0 |
| | (PD-L2 IgV) (G4S)3—(PD-L2 IgV) (G4S)2 knob Fc (G4S)3 (CD155 IgV) (G4S)3 (CD155 IgV) and hole Fc—(G4S)3—(PD-L2 IgV)—(G4S)3—(PD-L2 IgV) | 1200 + 1204 | 3311.8 | 1.4 |
| Controls | PDL2-IgV | 328 | 2367.2 | 1.0 |
| | CD155-IgV | 1598 | 2590.7 | 1.1 |
| | Fc Control (homodimer) | 1189 | 2617.9 | 1.1 |
| | Fc Control (heterodimer) | 1187 + 1188 | 2861.5 | 1.2 |
| | Wild Type CD155 full ECD Fc | 20 (ECD) | 2481.0 | 1.1 |
| | Wild Type PD-L2 full ECD Fc | 4 (ECD) | 3298.5 | 1.4 |
| | Irrelevant Ig Control | hIgG | 2297.6 | 1.0 |

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (2041 sequences)

SEQ ID NO: 1 - protein, 288 aa, Homo sapiens
  MISC_FEATURE: CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2 - protein, 329 aa, Homo sapiens
  MISC_FEATURE: CD86(B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 3 - protein, 290 aa, Homo sapiens
  MISC_FEATURE: CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 4 - protein, 273 aa, Homo sapiens
  MISC_FEATURE: PDCD1LG2(PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 5 - protein, 302 aa, Homo sapiens
  MISC_FEATURE: ICOSLG(B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 6 - protein, 534 aa, Homo sapiens
  MISC_FEATURE: CD276(B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 7 - protein, 282 aa, Homo sapiens
  MISC_FEATURE: VTCN1(B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 8 - protein, 220 aa, Homo sapiens
  MISC_FEATURE: CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 9 - protein, 223 aa, Homo sapiens
  MISC_FEATURE: CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 10 - protein, 288 aa, Homo sapiens
  MISC_FEATURE: PDCD1(PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 11 - protein, 199 aa, Homo sapiens
  MISC_FEATURE: ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 12 - protein, 289 aa, Homo sapiens
  MISC_FEATURE: BTLA(CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 13 - protein, 458 aa, Homo sapiens
  MISC_FEATURE: CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 14 - protein, 235 aa, Homo sapiens
  MISC_FEATURE: CD8A(CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 15 - protein, 210 aa, Homo sapiens
  MISC_FEATURE: CD8B(CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 16 - protein, 525 aa, Homo sapiens
  MISC_FEATURE: LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 17 - protein, 301 aa, Homo sapiens
  MISC_FEATURE: HAVCR2(TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 18 - protein, 526 aa, Homo sapiens
  MISC_FEATURE: CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 19 - protein, 244 aa, Homo sapiens
  MISC_FEATURE: TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 20 - protein, 417 aa, Homo sapiens
  MISC_FEATURE: PVR(CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 21 - protein, 538 aa, Homo sapiens
  MISC_FEATURE: PVRL2(CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 22 - protein, 336 aa, Homo sapiens
  MISC_FEATURE: CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 23 - protein, 351 aa, Homo sapiens
  MISC_FEATURE: CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 24 - protein, 180 aa, Homo sapiens
  MISC_FEATURE: CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 25 - protein, 278 aa, Homo sapiens
  MISC_FEATURE: CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 26 - protein, 325 aa, Homo sapiens [sequence omitted]

SEQ ID NO: 27 - protein, 201 aa, Homo sapiens
  MISC_FEATURE: NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 28 - protein, 208 aa, Homo sapiens [sequence omitted]

SEQ ID NO: 29 - protein, 224 aa, Homo sapiens
  MISC_FEATURE: CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 30 - protein, 220 aa, Homo sapiens
  MISC_FEATURE: CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 31 - protein, 201 aa, Homo sapiens
  MISC_FEATURE: PDCD1LG2(PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 32 - protein, 238 aa, Homo sapiens [sequence omitted]

SEQ ID NO: 33 - protein, 438 aa, Homo sapiens
  MISC_FEATURE: CD276(B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 34 - protein, 235 aa, Homo sapiens
  MISC_FEATURE: VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 35 - protein, 134 aa, Homo sapiens
  MISC_FEATURE: CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 36 - protein, 126 aa, Homo sapiens [sequence omitted]

SEQ ID NO: 37 - protein, 150 aa, Homo sapiens [sequence omitted]

SEQ ID NO: 38 - protein, 120 aa, Homo sapiens
  MISC_FEATURE: ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 39 - protein, 127 aa, Homo sapiens
  MISC_FEATURE: BTLA(CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 40 - protein, 371 aa, Homo sapiens
  MISC_FEATURE: CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 41 - protein, 161 aa, Homo sapiens
  MISC_FEATURE: CD8A(CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 42 - protein, 149 aa, Homo sapiens
  MISC_FEATURE: CD8B(CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 43 - protein, 422 aa, Homo sapiens
  MISC_FEATURE: LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 44 - protein, 181 aa, Homo sapiens
  MISC_FEATURE: HAVCR2(TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 45 - protein, 394 aa, Homo sapiens
  MISC_FEATURE: CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 46 - protein, 120 aa, Homo sapiens
  MISC_FEATURE: TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 47 - protein, 323 aa, Homo sapiens
  MISC_FEATURE: PVR(CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 48 - protein, 329 aa, Homo sapiens
  MISC_FEATURE: PVRL2(CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 49 - protein, 236 aa, Homo sapiens [sequence omitted]

SEQ ID NO: 50 - protein, 185 aa, Homo sapiens
  MISC_FEATURE: CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 51 - protein, 133 aa, Homo sapiens
  MISC_FEATURE: CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 52 - protein, 202 aa, Homo sapiens
  MISC_FEATURE: CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 53 - protein, 215 aa, Homo sapiens
  MISC_FEATURE: CD200R1(CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 54 - protein, 117 aa, Homo sapiens
  MISC_FEATURE: NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 55 - protein, 98 aa, Artificial Sequence
  PD-L2 IgV
FTVTVPKELYIIEHGSNVTLECNFDTGSHVNLGAITASLQKVENDTSPHRERATLLEEQLPLGKASFHIPQVQVRDEGQYQCIIIYGVAWDYKYLTLK

SEQ ID NO: 56 - protein, 201 aa, Artificial Sequence
  PD-L2 ECD v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 57 - protein, 201 aa, Artificial Sequence
  PD-L2 ECD v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 58 - protein, 201 aa, Artificial Sequence
  PD-L2 ECD v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 59 - protein, 201 aa, Artificial Sequence
  PD-L2 ECD v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 60 - protein, 201 aa, Artificial Sequence
  PD-L2 ECD v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 61 - protein, 201 aa, Artificial Sequence
  PD-L2 ECD v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 62 - protein, 201 aa, Artificial Sequence
  PD-L2 ECD v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 63 - protein, 201 aa, Artificial Sequence
  PD-L2 ECD v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 64 - protein, 201 aa, Artificial Sequence
  PD-L2 ECD v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 65 - protein, 201 aa, Artificial Sequence
  PD-L2 ECD v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 66 - protein, 201 aa, Artificial Sequence
  PD-L2 ECD v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 67 - protein, 201 aa, Artificial Sequence
  PD-L2 ECD v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 68 - protein, 201 aa, Artificial Sequence
  PD-L2 ECD v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 69 - protein, 201 aa, Artificial Sequence
  PD-L2 ECD v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 70 - protein, 201 aa, Artificial Sequence
  PD-L2 ECD v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 71 - protein, 201 aa, Artificial Sequence
  PD-L2 ECD v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 72 - protein, 201 aa, Artificial Sequence
  PD-L2 ECD v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 73 - protein, 201 aa, Artificial Sequence
  PD-L2 ECD v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 74 - protein, 201 aa, Artificial Sequence; identical to SEQ ID NO: 69
  PD-L2 ECD v19

SEQ ID NO: 75 - protein, 201 aa, Artificial Sequence
  PD-L2 ECD v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 76 - protein, 201 aa, Artificial Sequence
  PD-L2 ECD v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 77 - protein, 201 aa, Artificial Sequence
  PD-L2 ECD v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 78 - protein, 201 aa, Artificial Sequence
  PD-L2 ECD v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 79 - protein, 201 aa, Artificial Sequence
  PD-L2 ECD v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 80 - protein, 201 aa, Artificial Sequence
  PD-L2 ECD v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 81 - protein, 201 aa, Artificial Sequence
  PD-L2 ECD v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 82 - protein, 201 aa, Artificial Sequence
  PD-L2 ECD v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 83 - protein, 201 aa, Artificial Sequence
  PD-L2 ECD v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 84 - protein, 201 aa, Artificial Sequence
  PD-L2 ECD v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 85 - protein, 201 aa, Artificial Sequence
  PD-L2 ECD v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 86 - protein, 201 aa, Artificial Sequence
  PD-L2 ECD v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 87 - protein, 201 aa, Artificial Sequence
  PD-L2 ECD v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 88 - protein, 201 aa, Artificial Sequence
  PD-L2 ECD v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 89 - protein, 201 aa, Artificial Sequence
  PD-L2 ECD v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 90 - protein, 201 aa, Artificial Sequence
  PD-L2 ECD v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 91 - protein, 201 aa, Artificial Sequence
  PD-L2 ECD v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 92 - protein, 201 aa, Artificial Sequence
  PD-L2 ECD v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 93 - protein, 201 aa, Artificial Sequence
  PD-L2 ECD v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 94 - protein, 201 aa, Artificial Sequence
  PD-L2 ECD v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 95 - protein, 201 aa, Artificial Sequence
  PD-L2 ECD v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 96 - protein, 201 aa, Artificial Sequence
  PD-L2 ECD v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 97 - protein, 201 aa, Artificial Sequence
  PD-L2 ECD v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 98 - protein, 201 aa, Artificial Sequence
  PD-L2 ECD v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 99 - protein, 201 aa, Artificial Sequence
  PD-L2 ECD v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 100 - protein, 201 aa, Artificial Sequence
  PD-L2 ECD v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 101 - protein, 201 aa, Artificial Sequence
  PD-L2 ECD v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 102 - protein, 201 aa, Artificial Sequence
  PD-L2 ECD v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 103 - protein, 201 aa, Artificial Sequence
  PD-L2 ECD v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 104 - protein, 201 aa, Artificial Sequence
  PD-L2 ECD v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 105 - protein, 201 aa, Artificial Sequence
  PD-L2 ECD v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 106 - protein, 201 aa, Artificial Sequence
  PD-L2 ECD v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 107 - protein, 201 aa, Artificial Sequence
  PD-L2 ECD v52
  VARIANT (65)..(65): X is unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 108 - protein, 201 aa, Artificial Sequence
  PD-L2 ECD v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 109 - protein, 201 aa, Artificial Sequence
  PD-L2 ECD v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 110 - protein, 201 aa, Artificial Sequence
  PD-L2 ECD v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 111 - protein, 201 aa, Artificial Sequence
  PD-L2 ECD v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 112 - protein, 201 aa, Artificial Sequence
  PD-L2 ECD v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 113 - protein, 201 aa, Artificial Sequence
  PD-L2 ECD v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 114 - protein, 201 aa, Artificial Sequence
  PD-L2 ECD v59
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 115 - protein, 102 aa, Homo sapiens
  MISC_FEATURE: PD-L2 IgV wildtype
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 116 - protein, 201 aa, Artificial Sequence
  PD-L2 ECD v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 117 - protein, 201 aa, Artificial Sequence
  PD-L2 ECD v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 118 - protein, 201 aa, Artificial Sequence
  PD-L2 ECD v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 119 - protein, 201 aa, Artificial Sequence
  PD-L2 ECD v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 120 - protein, 201 aa, Artificial Sequence
  PD-L2 ECD v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 121 - protein, 201 aa, Artificial Sequence
  PD-L2 ECD v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 122 - protein, 201 aa, Artificial Sequence
  PD-L2 ECD v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 123 - protein, 201 aa, Artificial Sequence
  PD-L2 ECD v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 124 - protein, 201 aa, Artificial Sequence
  PD-L2 ECD v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 125 - protein, 201 aa, Artificial Sequence
  PD-L2 ECD v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 126 - protein, 201 aa, Artificial Sequence
  PD-L2 ECD v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 127 - protein, 201 aa, Artificial Sequence
  PD-L2 ECD v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 128 - protein, 201 aa, Artificial Sequence
  PD-L2 ECD v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 129 - protein, 201 aa, Artificial Sequence
  PD-L2 ECD v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 130 - protein, 201 aa, Artificial Sequence
  PD-L2 ECD v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 131 - protein, 201 aa, Artificial Sequence
  PD-L2 ECD v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 132 - protein, 201 aa, Artificial Sequence
  PD-L2 ECD v77
LFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 133 - protein, 98 aa, Artificial Seqeunce
  PD-L2 IgV v1
FTVTVPKELYIIEQGSNVTLECNFDTGSHVNLGAITASLQKVENDTSPHRERATLLEEQLPLGKASFHIPQVQVRDEGQYQCIIIYGVAWDYKYLTLK

SEQ ID NO: 134 - protein, 98 aa, Artificial Sequence
  PD-L2 IgV v2
FTVTVPKELYIIEHGSNVTLECDFDTGSHVNLGAITASLQKVENDTSPHRERATLLEEQLPLGKASFHIPQVQVRDEGQYQCIIIYGVAWDYKYLTLK

SEQ ID NO: 135 - protein, 98 aa, Artificial Sequence
  PD-L2 IgV v3
FTVTVPKELYIIEHGSNVTLECNFDTGSHVNLGAITASLQKVDNDTSPHRERATLLEEQLPLGKASFHIPQVQVRDEGQYQCIIIYGVAWDYKYLTLK

SEQ ID NO: 136 - protein, 98 aa, Artificial Sequence
  PD-L2 IgV v4
FTVTVPKELYIIEHGSNVTLECNFDTGSHVNLGAITASLQKVENDTSPHRERATLLEEQLPLGKASFHIPQVQVRDEGQYQCIIIYGDAWDYKYLTLK

SEQ ID NO: 137 - protein, 98 aa, Artificial Sequence
  PD-L2 IgV v5
FTVTVPKELYIIEHGSNVTLECNFDTGSHVNLGAITASLQKVENDTSPHRERATLLEEQLPLGKASFHIPQVQVRDEGQYRCIIIYGDAWDYKYLTLK

SEQ ID NO: 138 - protein, 98 aa, Artificial Sequence
  PD-L2 IgV v6
FTVTVPKELYIIEHGSNVTLECNFDTGSHVNLGAITASLQKVENDTSPHRERATLLEGQLPLGKASFHIPQVQVRDEGQYRCIIIYGVAWDYKYLTLK

SEQ ID NO: 139 - protein, 98 aa, Artificial Sequence
  PD-L2 IgV v7
FTVTVPKELYIIEHGSNVTLECNFDTGSHVNLGAITAILQKVENDTSPHRERATLLEEQLPLGKASFHIPQVQVRDEGQYQCIIIYGDAWDYKYLTLK

SEQ ID NO: 140 - protein, 98 aa, Artificial Sequence
  PD-L2 IgV v8
FTVTVPKELYIIEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 141 - protein, 98 aa, Artificial Sequence
  PD-L2 IgV v9
FTVTVPKELYIIEHGSNVTLECNFDTGSHVNLGAITASLQKVENDTSPHRERATLLEEQLPLGKALFHIPQVQVRDEGQYQCIFIYGVAWDYKYLTLK

SEQ ID NO: 142 - protein, 98 aa, Artificial Sequence
  PD-L2 IgV v10
FTVTVPKELYIIEHGSNVTLECNFDTGSHVNLGAITASLQKVENDTSPHRERATLLEEQLPLGKALFHIPQVQVRDEGQYQCIITYGVAWDYKYLTLK

SEQ ID NO: 143 - protein, 98 aa, Artificial Sequence
  PD-L2 IgV v11
FTVTVPKELYIIEQGSNVTLECNFDTGSHVNLGAITASLQKVENDTSPHRERATLLEEQLPLGRASFHIPQVQVRDEGQYQCIIIYGVAWDYKYLTLK

SEQ ID NO: 144 - protein, 98 aa, Artificial Sequence
  PD-L2 IgV v12
FTVTVPKELYIIEQGSNVTLECNFDTGSHVNLGAITASLQKVENDTSPHRERATLLEEQLPLGKASFHIPHVQVRDEGQYQCIIIYGDAWDYKYLTLK

SEQ ID NO: 145 - protein, 98 aa, Artificial Sequence
  PD-L2 IgV v13
FTVTVPKELYIIEQGSNVTLECNFDTGSHVNLGAITASLQKVENDTSPHRERATLLEEQLPLGKALFHIPQVQVGDEGQYQCIIIYGVAWDYKYLTLK

SEQ ID NO: 146 - protein, 98 aa, Artificial Sequence
  PD-L2 IgV v14
FTVTVPKELYIIEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 147 - protein, 98 aa, Artificial Sequence
  PD-L2 IgV v15
FTVTVPKELYIIEQGSNVTLECNFDTGSHVNLGAITASLQKVENDASPHRERATLLEEQLPLGKASFHIPQVQVRDEGQYRCIIIYGVAWDYKYLTLK

SEQ ID NO: 148 - protein, 98 aa, Artificial Sequence
  PD-L2 IgV v16
FTVTVPKELYIIEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 149 - protein, 98 aa, Artificial Sequence
  PD-L2 IgV v17
FTVTVPKELYIIEQGSNVTLESNFDTGSHVNLGAITASLQKVENDTSPHRERATLLEEQLPLGKASFHIPQVQVRDEGQYQCIITYGVAWDYKYLTLK

SEQ ID NO: 150 - protein, 98 aa, Artificial Sequence
  PD-L2 IgV v18
FTVTVPKELYIIEQGSNVTLECNFDTGSHVNLGAITAILQKVENDTSPHRERATLLEEQLPLGKASFHIPQVQVRDEGQYQCIITYGVAWDYKYLTLK

SEQ ID NO: 151 - protein, 98 aa, Artificial Sequence; identical to SEQ ID NO: 146
  PD-L2 IgV v19

SEQ ID NO: 152 - protein, 98 aa, Artificial Sequence
  PD-L2 IgV v20
FTVTVPKELYIIEHGSNVTLECNFDTGSHVNLGAITASLQKVDNDTSPHRERATLLEEQLPLGKASFHIPQVQVRDEGQYQCIIIYGDARDYKYLTLK

SEQ ID NO: 153 - protein, 98 aa, Artificial Sequence
  PD-L2 IgV v21
FTVTVPKELYIVEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 154 - protein, 98 aa, Artificial Sequence
  PD-L2 IgV v22
FTVTVPKELYIIEQGSNVTLECNFDTGSHVNLGAITASLQKVENDTSPHRERATLLEEQLPLGKALFHIPQVQVRDEGQYQCIITYGVAWDYKYLTLK

SEQ ID NO: 155 - protein, 98 aa, Artificial Sequence
  PD-L2 IgV v23
FTVTVPKELYIVEQGSNVTLECNFDTGSHVNLGAITASLQKVENDTSPHRERATLLEEQLPLGKALFHIPQVQVRDEGQYQCIITYGVAWDYKYLTLK

SEQ ID NO: 156 - protein, 98 aa, Artificial Sequence
  PD-L2 IgV v24
FTVTVPKELYIVEQGSNVTLECNFDTGSHVNLGAITASLQKVDNDTSPHRERATLLEEQLPLGKASFHIPQVQVRDEGQYQCIIIYGDAWDYKYLTLK

SEQ ID NO: 157 - protein, 98 aa, Artificial Sequence
  PD-L2 IgV v25
FTVTVPKELYIVEHGSNVTLECNFDTGSHVNLGAITAILQKVDNDTSPHRERATLLEEQLPLGKASFHIPQVQVRDEGQYRCIIIYGDAWDYKYLTLK

SEQ ID NO: 158 - protein, 98 aa, Artificial Sequence
  PD-L2 IgV v26
FTVTVPKELYIVEHGSNVTLECNFDTGSHVNLGAITASLQKVDNDTSPHRERATLLEEQLPLGKASFHIPQVQVRDEGQYRCIIIYGDAWDYKYLTLK

SEQ ID NO: 159 - protein, 98 aa, Artificial Sequence
  PD-L2 IgV v27
FTVTVPKELYIVEHGSNVTLECNFDTGSHVNLGAITASLQKVENDTSPHRERATLLEEQLPLGKASFHIPHVQVGDEGQYQCIITYGVAWDYKYLTLK

SEQ ID NO: 160 - protein, 98 aa, Artificial Sequence
  PD-L2 IgV v28
FTVTVPKELYIVEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 161 - protein, 98 aa, Artificial Sequence
  PD-L2 IgV v29
FTVTVPKELYIIEQGSNVTLECNFDTGSHVNLGAITAILQKVENDTSPHRERATLLEEQLPLGKASFHIPQVQVGDEGQYQCIIIYGDAWDYKYLTLK

SEQ ID NO: 162 - protein, 98 aa, Artificial Sequence
  PD-L2 IgV v30
FTVTVPKELYIIEQGSNVTLECNFDTGSHVNLGAITASLQKVENDTSPHRERATLLEEQLPLGKALFHIPQVQVGDEGQYQCIFIYGVAWDYKYLTLK

SEQ ID NO: 163 - protein, 98 aa, Artificial Sequence
  PD-L2 IgV v31
FTVTVPKELYIIEQGSNVTLECNFDTGSHVNLGAITASLQKVENDASPHRERATLLEEQLPLGKASFHIPHVQVGDEGQYQCIITYGVAWDYKYLTLK

SEQ ID NO: 164 - protein, 98 aa, Artificial Sequence
  PD-L2 IgV v32
FTVTVPKELYIIEQGSNVTLECNFDTGSHVNLGAITASLQKVENDASPHRERATLLEEQLPLGKASFHIPHVQVGDEGQYQCIIIYGVAWDYKYLTLK

SEQ ID NO: 165 - protein, 98 aa, Artificial Sequence
  PD-L2 IgV v33
FTVTVPKELYIVEQGSNVTLECNFDTGSHVNLGAITASLQKVENDASPHRERATLLEEQLPLGKASFHIPHVQVGDEGQYQCIIIYGVAWDYKYLTLK

SEQ ID NO: 166 - protein, 98 aa, Artificial Sequence
  PD-L2 IgV v34
FTVTVPKELYIIEQGSNVTLECNFDTGSHVNLGAITASLQKVDNDTSPHRERATLLEEQLPLGKASFHIPQVQVGDEGQYQCIFIYGVAWDYKYLTLK

SEQ ID NO: 167 - protein, 98 aa, Artificial Sequence
  PD-L2 IgV v35
FTVTVPKELYIIEQGSNVTLECNFDTGSHVNLGAITAILQKVENDTSPHRERATLLEEQLPLGKALFHIPQVQVRDEGQYQCIIIYGDAWDYKYLTLK

SEQ ID NO: 168 - protein, 98 aa, Artificial Sequence
  PD-L2 IgV v36
FTVTVPKELYIIEQGSNVTLECNFDTGSHVDLGAITASLQKVENDTSPHRERATLLEEQLPLGKALFHIPQVQVRDEGQYQCIIIYGDAWDYKYLTLK

SEQ ID NO: 169 - protein, 98 aa, Artificial Sequence
  PD-L2 IgV v37
FTVTVPKELYIIEHGSNVTLECNFDTGSHVDLGAITASLQKVENDTSPHRERATLLEEQLPLGKALFHIPQVQVRDEGQYQCIIIYGDAWDYKYLTLK

SEQ ID NO: 170 - protein, 98 aa, Artificial Sequence
  PD-L2 IgV v38
FTVTVPKELYIIEQGSNVTLECNFDTGSHVNLGAITASLQKVENDTSPHRERATLLEEQLPLGKALFHIPHVQVGDEGQYQCIIIYGDAWDYKYLTLK

SEQ ID NO: 171 - protein, 98 aa, Artificial Sequence
  PD-L2 IgV v39
FTVTVPKELYIIEQGSNVTLECNFDTGSHVNLGAITASLQKVENDTSPHRERATLLEEQLPLGKASFHIPHVRVGDEGQYQCIITYGVAWDYKYLTLK

SEQ ID NO: 172 - protein, 98 aa, Artificial Sequence
  PD-L2 IgV v40
FTVTVPKELYIIEHGSNVTLECNFDTVSHVNLGAITASLQKVENDTSPHRERATLLEEQLPLGKASFHIPHVQVGDEGQYQCIITYGVAWDYKYLTLK

SEQ ID NO: 173 - protein, 98 aa, Artificial Sequence
  PD-L2 IgV v41
FTVTVPKELYIVEQGSNVTLECNFDTGSHVNLGAITAILQKVDNDTSPHRERATLLEEQLPLGKALFHIPQVQVRDEGQYQCIIIYGVAWDYKYLTLK

SEQ ID NO: 174 - protein, 98 aa, Artificial Sequence
  PD-L2 IgV v42
FTVTVPKELYIIEHGSNVTLECNFDTGSHVNLGAITASLQKVDNDTSPHRERATLLEEQLPLGKALFHIPHVQVRDEGQYRCIIIYGDAWDYKYLTLK

SEQ ID NO: 175 - protein, 98 aa, Artificial Sequence
  PD-L2 IgV v43
FTVTVPKELYIIEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 176 - protein, 98 aa, Artificial Sequence
  PD-L2 IgV v44
FTVTVPKELYIIEQGSNVTLECNFDTGSHVNLGAITASLQKVENDASPHRERATLLEEQLPLGKASFHIPQVQVRDEGQYQCIIIYGVAWDYKYLTLK

SEQ ID NO: 177 - protein, 98 aa, Artificial Sequence
  PD-L2 IgV v45
FTVTVPKELYIVEQGSNVTLECNFDTGSHVNLGAITASLQKVENDTSPHRERATLLEEQLPLGKASFHIPQVQVRDEGQYRCIIIYGVAWDYKYLTLK

SEQ ID NO: 178 - protein, 98 aa, Artificial Sequence
  PD-L2 IgV v46
FTVTVPKELYIVEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 179 - protein, 98 aa, Artificial Sequence
  PD-L2 IgV v47
FTVTVPKELYIVEHGSNVTLECNFDTGSHVNLGAITASLQKVENDTSPHRERATLLEEQLPLGKALFHIPQVQVRDEGQYRCIIIYGDAWDYKYLTLK

SEQ ID NO: 180 - protein, 98 aa, Artificial Sequence
  PD-L2 IgV v48
FTVTVPKELYIVEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 181 - protein, 98 aa, Artificial Sequence
  PD-L2 IgV v49
FTVTVPKELYIIEQGSNVTLECNFDTGSHMNLGAITASLQKVENDTSPHRERATLLEEQLPLGKALFHIPQVQVRDEGQYRCIIIYGDAWDYKYLTLK

SEQ ID NO: 182 - protein, 98 aa, Artificial Sequence
  PD-L2 IgV v50
FTVTVPKELYIVEQGSNVTLECNFDTGSHVNLGAITASLQKVENDASPHRERATLLEEQLPLGKASFHIPQVQVRDEGQYRCIIIYGVAWDYKYLTLK

SEQ ID NO: 183 - protein, 98 aa, Artificial Sequence
  PD-L2 IgV v51
FTVTVPKELYIVEQGSNVTLECNFDTGSHANLGAITASLQKVESDTSPHRERATLLEEQLPLGKASFHIPQVQVRDEGQYRCIIIYGDAWDYKYLTLK

SEQ ID NO: 184 - protein, 98 aa, Artificial Sequence
  PD-L2 IgV v52
  VARIANT (64)..(64): X is unknown
FTVTVPKELYIVEHGSNVALECNFDTGSHVNLGAITASLQKVENDASPHRERATLLEEQLPLGXASFHIPQVQVRDEGQYRCIIIYGDAWDYKYLTLK

SEQ ID NO: 185 - protein, 98 aa, Artificial Sequence
  PD-L2 IgV v53
FTVTVPKELYIIEQGSNVTLECNFDTGSHVNLGAITASLQKVENDASPHRERATLLEEQLPLGKASFLIPQVQVRDEGQYRCIIIYGDAWDYKYLTLK

SEQ ID NO: 186 - protein, 98 aa, Artificial Sequence
  PD-L2 IgV v54
FTVTVPKELYIVEQGSNVTLECNFDTGSHVNLGAITASLQKVENDASPHRERATLLEEQLPLGKASFLIPQVQVGDEGQYQCIIIYGDAWDYKYLTLK

SEQ ID NO: 187 - protein, 98 aa, Artificial Sequence
  PD-L2 IgV v55
FTVTVPKELYVVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 188 - protein, 98 aa, Artificial Sequence
  PD-L2 IgV v56
FTVTVPKELYIVEQGSNVTLECNFDTGSHVNLGAITASLQKVENDTSPHRERATLLEEQLPLGKASFHIPQVQVGNEGQYRCIIIYGDAWDYKYLTLK

SEQ ID NO: 189 - protein, 98 aa, Artificial Sequence
  PD-L2 IgV v57
FTVTVPKELYIVEQGSNVTLECNFDTGSHVNLGAITASLQKVENDASPHRERATLLEEQLPLGKASFHIPQVQVGDEGQYQCIIIYGDAWDYKYLTLK

SEQ ID NO: 190 - protein, 98 aa, Artificial Sequence
  PD-L2 IgV v58
FTVTVPKELYIVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 191 - protein, 98 aa, Artificial Sequence
  PD-L2 IgV v60
FTVTVPKELYIVEQGSNVTLECDFDTGSHVNLGAITASLQKVENDTSPHRERATLLEEQLPLGKASFHIPQVQVRDEGQYRCIIIYGDAWDYKYLTLK

SEQ ID NO: 192 - protein, 98 aa, Artificial Sequence; identical to SEQ ID NO: 190
  PD-L2 IgV v60

SEQ ID NO: 193 - protein, 98 aa, Artificial Sequence
  PD-L2 IgV v61
FTVTVPKELYIVEQGSNVTLECNFDTGSHVNLGAVTASLQKVENDASPHRERATLLEEQLPLGKALFHIPQVQVRDEGQYQCIIIYGDAWDYKYLTLK

SEQ ID NO: 194 - protein, 98 aa, Artificial Sequence
  PD-L2 IgV v62
FTVTVPKELYIIEQGSNVTLECNFDTGSHVNLGAITASLQKVENDASPHRERATLLEEQLPLGRALFHIPQVQVRDEGQYRCIIIYGDAWDYKYLTLK

SEQ ID NO: 195 - protein, 98 aa, Artificial Sequence
  PD-L2 IgV v63
FTVTVPKELYIIEQGSNVTLECNFDTGSHVNPGAITASLQKVENDASPHRERATLLEEQLPLGKALFHISQVQVRDEGQYQCIIIYGDAWDYKYLTLK

SEQ ID NO: 196 - protein, 98 aa, Artificial Sequence
  PD-L2 IgV v64
FTVTVPKELYIVEQGSNVTLECNFDTGSHVNLGAITASLQKVENDTSPHRERATLLEEQLPLGKASFHIPHVQVGDEGQYQCIITYGVAWDYKYLTLK

SEQ ID NO: 197 - protein, 98 aa, Artificial Sequence
  PD-L2 IgV v65
FTVTVPKELYIIEQGSNVTLECNFDTGSHVNLGAITASLQKVENDASPHRERATLLEEQLPLGKALFHIPQVQVRDEGQYRCIIIYGDAWDYKYLTLK

SEQ ID NO: 198 - protein, 98 aa, Artificial Sequence
  PD-L2 IgV v66
LTVTVPKELYIIEQGSNVTLECNFDTGSHVNLGAITASLQKVENEASPHRERATLLEEQLPLGKASFHIPHVQVGDEGQYRCIIIYGDAWDYKYLTLK

SEQ ID NO: 199 - protein, 98 aa, Artificial Sequence
  PD-L2 IgV v67
FTVTVPKELYIVEQGSNVTLECNFDTGSHVNFGAITASLQKVENDASPHRERATLLEEQLPLGKASFHIPQVQVRDEGQYRCIIIYGDAWDYKYLTLK

SEQ ID NO: 200 - protein, 98 aa, Artificial Sequence
  PD-L2 IgV v68
FTVTVPKELYIVEQGSNVTLECNFDTGSHVNLGAITASLQKVENDASPHRERATLLGEQLPLGKALFHIPQVQVRDEGQYRCIIIYGDAWDYKYLTLK

SEQ ID NO: 201 - protein, 98 aa, Artificial Sequence
  PD-L2 IgV v69
FTVTVPKELYIIEQGSNVTLECSFDTGSHVNLGAITASLQKVENDASPHRERATLLEEQLPLGKASFHIPHVQVGDEGQYQCIIIYGDAWDYKYLTLK

SEQ ID NO: 202 - protein, 98 aa, Artificial Sequence
  PD-L2 IgV v70
FTVTVPKELYIVEQGSNVTLECNFDTGSHVNLGAITASLQKVVNDASPHRERATLLEEQLPLGKASFHIPQVQVRDEGQYRCIIIYGDAWDYKYLTLK

SEQ ID NO: 203 - protein, 98 aa, Artificial Sequence
  PD-L2 IgV v71
FTVTVPKELYIIEQGSDVTLECNFDTGSHVNLGAITASLQKVENDASPHRERATLLEEQLPLGKASFHIPHAQVGDEGQYQCIITYGDAWDYKYLTLK

SEQ ID NO: 204 - protein, 98 aa, Artificial Sequence
  PD-L2 IgV v72
FTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLK

SEQ ID NO: 205 - protein, 98 aa, Artificial Sequence
  PD-L2 IgV v73
FTVTVPKELYIIEQGSNVTLECNFDTGSHVNHGAITASLQKVENDTSPHRERATLLEEQLPLGKALFHIPQVQVGDEGQYRCIIIYGDAWDYKYLTLK

SEQ ID NO: 206 - protein, 98 aa, Artificial Sequence
  PD-L2 IgV v74
FTVTVPKELYIVEQGSNVTLECNFDTGSHVNLGAITASLQKVENDASPHRERATLLEEQLPLGKASFHIPHVQVGDEGQYQCIITYGVAWDYKYLTLK

SEQ ID NO: 207 - protein, 98 aa, Artificial Sequence
  PD-L2 IgV v75
FTVTVPKELYIIEQGSNVTLECNFDTGSHVNLGAITAILQKVDNDTSPHRERATLLEEQLPLGKASFHIPHVQGGDEGQYRCIIIYGDAWDYKYLTLK

SEQ ID NO: 208 - protein, 98 aa, Artificial Sequence
  PD-L2 IgV v76
FTVTVPKELYIIEQGSNVTLECNFDTGSHVNLGAITASLQKVENDASPHRERATLLEEQLPLGKALFHIPQVQVGDEGQYRCIIIYGDAWDYKYLTLK

SEQ ID NO: 209 - protein, 98 aa, Artificial Sequence
  PD-L2 IgV v77
FTVTVPKELYIVEQGSNVTLECNFDTGSHVNLGAITASLQKVENDASPHRERATLLEEQLPLGKALFHIPHVQVGDEGQYRCIIIYGDAWDYKYLTLK

SEQ ID NO: 210 - protein, 19 aa, Artificial Sequence
  VH signal peptide
MGSTAILALLLAVLQGVSA

SEQ ID NO: 211 - protein, 232 aa, Artificial Sequence
  IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 235 aa, Artificial Sequence
  IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 213 - protein, 254 aa, Homo sapiens
  MISC_FEATURE: Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 214 - protein, 306 aa, Homo sapiens
  MISC_FEATURE: Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 215 - protein, 272 aa, Homo sapiens
  MISC_FEATURE: Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 216 - protein, 254 aa, Homo sapiens
  MISC_FEATURE: Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 217 - protein, 284 aa, Homo sapiens
  MISC_FEATURE: Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 218 - protein, 506 aa, Homo sapiens
  MISC_FEATURE: Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 219 - protein, 258 aa, Homo sapiens
  MISC_FEATURE: Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 220 - protein, 202 aa, Homo sapiens
  MISC_FEATURE: Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 221 - protein, 188 aa, Homo sapiens
  MISC_FEATURE: Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 222 - protein, 268 aa, Homo sapiens
  MISC_FEATURE: Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 223 - protein, 179 aa, Homo sapiens
  MISC_FEATURE: Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 224 - protein, 259 aa, Homo sapiens
  MISC_FEATURE: Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 225 - protein, 433 aa, Homo sapiens
  MISC_FEATURE: Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 226 - protein, 214 aa, Homo sapiens
  MISC_FEATURE: Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 227 - protein, 189 aa, Homo sapiens
  MISC_FEATURE: Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 228 - protein, 497 aa, Homo sapiens
  MISC_FEATURE: Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 229 - protein, 280 aa, Homo sapiens
  MISC_FEATURE: Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 230 - protein, 492 aa, Homo sapiens
  MISC_FEATURE: Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 231 - protein, 222 aa, Homo sapiens
  MISC_FEATURE: Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 232 - protein, 397 aa, Homo sapiens
  MISC_FEATURE: Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 233 - protein, 507 aa, Homo sapiens
  MISC_FEATURE: Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 234 - protein, 318 aa, Homo sapiens
  MISC_FEATURE: Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 235 - protein, 327 aa, Homo sapiens
  MISC_FEATURE: Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 236 - protein, 154 aa, Homo sapiens
  MISC_FEATURE: Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 237 - protein, 248 aa, Homo sapiens
  MISC_FEATURE: Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 238 - protein, 297 aa, Homo sapiens
  MISC_FEATURE: Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 239 - protein, 183 aa, Homo sapiens
  MISC_FEATURE: Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 240 - protein, 414 aa, Homo sapiens
  MISC_FEATURE: VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 241 - protein, 393 aa, Homo sapiens
  MISC_FEATURE: Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 242 - protein, 242 aa, Homo sapiens
  MISC_FEATURE: VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 243 - protein, 16 aa, Artificial Sequence
  CD33 Signal Peptide
MPLLLLLPLLWAGALA

SEQ ID NO: 244 - protein, 22 aa, Artificial Sequence
  IgGkappa light chain
MDMRVLAQLLGLLLLCFPGARC

SEQ ID NO: 245 - protein, 18 aa, Artificial Sequence
  HSA signal peptide
MKWVTFISLLFLFSSAYS

SEQ ID NO: 246 - protein, 22 aa, Artificial Sequence
  Ig kappa light chain
MDMRAPAGIFGFLLVLFPGYRS

SEQ ID NO: 247 - protein, 19 aa, Artificial Sequence
  Human azurocidin preprotein signal sequence
MTRLTVLALLAGLLASSRA

SEQ ID NO: 248 - protein, 19 aa, Artificial Sequence
  IgG heavy chain signal peptide
MELGLSWIFLLAILKGVQC

SEQ ID NO: 249 - protein, 19 aa, Artificial Sequence
  IgG heavy chain signal peptide
MELGLRWVFLVAILEGVQC

SEQ ID NO: 250 - protein, 19 aa, Artificial Sequence
  IgG heavy chain signal peptide
MKHLWFFLLLVAAPRWVLS

SEQ ID NO: 251 - protein, 19 aa, Artificial Sequence
  IgG heavy chain signal peptide
MDWTWRILFLVAAATGAHS

SEQ ID NO: 252 - protein, 19 aa, Artificial Sequence
  IgG heavy chain signal peptide
MDWTWRFLFVVAAATGVQS

SEQ ID NO: 253 - protein, 19 aa, Artificial Sequence
  IgG heavy chain signal peptide
MEFGLSWLFLVAILKGVQC

SEQ ID NO: 254 - protein, 19 aa, Artificial Sequence
  IgG heavy chain signal peptide
MEFGLSWVFLVALFRGVQC

SEQ ID NO: 255 - protein, 26 aa, Artificial Sequence
  IgG heavy chain signal peptide
MDLLHKNMKHLWFFLLLVAAPRWVLS

SEQ ID NO: 256 - protein, 22 aa, Artificial Sequence
  IgG Kappa light chain signal seqeunce
MDMRVPAQLLGLLLLWLSGARC

SEQ ID NO: 257 - protein, 22 aa, Artificial Sequence
  IgG Kappa light chain signal seqeunce
MKYLLPTAAAGLLLLAAQPAMA

SEQ ID NO: 258 - protein, 17 aa, Artificial Sequence
  Gaussia luciferase
MGVKVLFALICIAVAEA

SEQ ID NO: 259 - protein, 18 aa, Artificial Sequence
  Human albumin
MKWVTFISLLFLFSSAYS

SEQ ID NO: 260 - protein, 18 aa, Artificial Sequence
  Human chymotrypsinogen
MAFLWLLSCWALLGTTFG

SEQ ID NO: 261 - protein, 14 aa, Artificial Sequence
  Human interleukin-2
MQLLSCIALILALV

SEQ ID NO: 262 - protein, 15 aa, Artificial Sequence
  Human trysinogen-2
MNLLLILTFVAAAVA

SEQ ID NO: 263 - protein, 15 aa, Artificial Sequence
  IgV-IgV linker
GGGGSGGGGSGGGGS

SEQ ID NO: 264 - protein, 10 aa, Artificial Sequence
  IgV-Fc linker 1
GGGGSGGGGS

SEQ ID NO: 265 - protein, 13 aa, Artificial Sequence
  IgV-Fc linker 2
GGGGSGGGGSAAA

SEQ ID NO: 266 - protein, 71 aa, Artificial Sequence
  CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 267 - protein, 112 aa, Artificial Sequence
  CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 268 - protein, 102 aa, Artificial Seqeunce
  PD-L2 IgV v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 269 - protein, 102 aa, Artificial Sequence
  PD-L2 IgV v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKA

SEQ ID NO: 270 - protein, 102 aa, Artificial Sequence
  PD-L2 IgV v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKA

SEQ ID NO: 271 - protein, 102 aa, Artificial Sequence
  PD-L2 IgV v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 272 - protein, 102 aa, Artificial Sequence
  PD-L2 IgV v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 273 - protein, 102 aa, Artificial Sequence
  PD-L2 IgV v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKA

SEQ ID NO: 274 - protein, 102 aa, Artificial Sequence
  PD-L2 IgV v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKA

SEQ ID NO: 275 - protein, 102 aa, Artificial Sequence
  PD-L2 IgV v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 276 - protein, 102 aa, Artificial Sequence
  PD-L2 IgV v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKA

SEQ ID NO: 277 - protein, 102 aa, Artificial Sequence
  PD-L2 IgV v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 278 - protein, 102 aa, Artificial Sequence
  PD-L2 IgV v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKA

SEQ ID NO: 279 - protein, 102 aa, Artificial Sequence
  PD-L2 IgV v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKA

SEQ ID NO: 280 - protein, 102 aa, Artificial Sequence
  PD-L2 IgV v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKA

SEQ ID NO: 281 - protein, 102 aa, Artificial Sequence
  PD-L2 IgV v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 282 - protein, 102 aa, Artificial Sequence
  PD-L2 IgV v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 283 - protein, 102 aa, Artificial Sequence
  PD-L2 IgV v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 284 - protein, 102 aa, Artificial Sequence
  PD-L2 IgV v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKA

SEQ ID NO: 285 - protein, 102 aa, Artificial Sequence
  PD-L2 IgV v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKA

SEQ ID NO: 286 - protein, 102 aa, Artificial Sequence; identical to SEQ ID NO: 281
  PD-L2 IgV v19

SEQ ID NO: 287 - protein, 102 aa, Artificial Sequence
  PD-L2 IgV v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKA

SEQ ID NO: 288 - protein, 102 aa, Artificial Sequence
  PD-L2 IgV v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 289 - protein, 102 aa, Artificial Sequence
  PD-L2 IgV v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 290 - protein, 102 aa, Artificial Sequence
  PD-L2 IgV v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 291 - protein, 102 aa, Artificial Sequence
  PD-L2 IgV v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKA

SEQ ID NO: 292 - protein, 102 aa, Artificial Sequence
  PD-L2 IgV v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKA

SEQ ID NO: 293 - protein, 102 aa, Artificial Sequence
  PD-L2 IgV v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKA

SEQ ID NO: 294 - protein, 102 aa, Artificial Sequence
  PD-L2 IgV v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 295 - protein, 102 aa, Artificial Sequence
  PD-L2 IgV v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 296 - protein, 102 aa, Artificial Sequence
  PD-L2 IgV v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKA

SEQ ID NO: 297 - protein, 102 aa, Artificial Sequence
  PD-L2 IgV v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKA

SEQ ID NO: 298 - protein, 102 aa, Artificial Sequence
  PD-L2 IgV v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 299 - protein, 102 aa, Artificial Sequence
  PD-L2 IgV v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 300 - protein, 102 aa, Artificial Sequence
  PD-L2 IgV v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 301 - protein, 102 aa, Artificial Sequence
  PD-L2 IgV v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKA

SEQ ID NO: 302 - protein, 102 aa, Artificial Sequence
  PD-L2 IgV v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKA

SEQ ID NO: 303 - protein, 102 aa, Artificial Sequence
  PD-L2 IgV v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 304 - protein, 102 aa, Artificial Sequence
  PD-L2 IgV v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 305 - protein, 102 aa, Artificial Sequence
  PD-L2 IgV v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKA

SEQ ID NO: 306 - protein, 102 aa, Artificial Sequence
  PD-L2 IgV v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKA

SEQ ID NO: 307 - protein, 102 aa, Artificial Sequence
  PD-L2 IgV v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKA

SEQ ID NO: 308 - protein, 102 aa, Artificial Sequence
  PD-L2 IgV v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKA

SEQ ID NO: 309 - protein, 102 aa, Artificial Sequence
  PD-L2 IgV v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKA

SEQ ID NO: 310 - protein, 102 aa, Artificial Sequence
  PD-L2 IgV v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 311 - protein, 102 aa, Artificial Sequence
  PD-L2 IgV v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKA

SEQ ID NO: 312 - protein, 102 aa, Artificial Sequence
  PD-L2 IgV v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKA

SEQ ID NO: 313 - protein, 102 aa, Artificial Sequence
  PD-L2 IgV v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 314 - protein, 102 aa, Artificial Sequence
  PD-L2 IgV v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKA

SEQ ID NO: 315 - protein, 102 aa, Artificial Sequence
  PD-L2 IgV v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 316 - protein, 102 aa, Artificial Sequence
  PD-L2 IgV v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKA

SEQ ID NO: 317 - protein, 102 aa, Artificial Sequence
  PD-L2 IgV v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 318 - protein, 102 aa, Artificial Sequence
  PD-L2 IgV v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKA

SEQ ID NO: 319 - protein, 102 aa, Artificial Sequence
  PD-L2 IgV v52
  VARIANT (65)..(65): X is unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKA

SEQ ID NO: 320 - protein, 102 aa, Artificial Sequence
  PD-L2 IgV v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKA

SEQ ID NO: 321 - protein, 102 aa, Artificial Sequence
  PD-L2 IgV v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKA

SEQ ID NO: 322 - protein, 102 aa, Artificial Sequence
  PD-L2 IgV v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 323 - protein, 102 aa, Artificial Sequence
  PD-L2 IgV v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKA

SEQ ID NO: 324 - protein, 102 aa, Artificial Sequence
  PD-L2 IgV v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKA

SEQ ID NO: 325 - protein, 102 aa, Artificial Sequence
  PD-L2 IgV v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 326 - protein, 102 aa, Artificial Sequence
  PD-L2 IgV v60
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKA

SEQ ID NO: 327 - protein, 102 aa, Artificial Sequence
  PD-L2 IgV v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKA

SEQ ID NO: 328 - protein, 102 aa, Artificial Sequence
  PD-L2 IgV v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 329 - protein, 102 aa, Artificial Sequence
  PD-L2 IgV v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKA

SEQ ID NO: 330 - protein, 102 aa, Artificial Sequence
  PD-L2 IgV v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 331 - protein, 102 aa, Artificial Sequence
  PD-L2 IgV v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKA

SEQ ID NO: 332 - protein, 102 aa, Artificial Sequence
  PD-L2 IgV v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKA

SEQ ID NO: 333 - protein, 102 aa, Artificial Sequence
  PD-L2 IgV v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKA

SEQ ID NO: 334 - protein, 102 aa, Artificial Sequence
  PD-L2 IgV v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKA

SEQ ID NO: 335 - protein, 102 aa, Artificial Sequence
  PD-L2 IgV v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKA

SEQ ID NO: 336 - protein, 102 aa, Artificial Sequence
  PD-L2 IgV v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKA

SEQ ID NO: 337 - protein, 102 aa, Artificial Sequence
  PD-L2 IgV v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKA

SEQ ID NO: 338 - protein, 102 aa, Artificial Sequence
  PD-L2 IgV v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKA

SEQ ID NO: 339 - protein, 102 aa, Artificial Sequence
  PD-L2 IgV v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKA

SEQ ID NO: 340 - protein, 102 aa, Artificial Sequence
  PD-L2 IgV v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 341 - protein, 102 aa, Artificial Sequence
  PD-L2 IgV v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKA

SEQ ID NO: 342 - protein, 102 aa, Artificial Sequence
  PD-L2 IgV v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKA

SEQ ID NO: 343 - protein, 102 aa, Artificial Sequence
  PD-L2 IgV v77
LFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKA

SEQ ID NO: 344 - protein, 116 aa, Homo sapiens
  MISC_FEATURE: CD155 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWL

SEQ ID NO: 345 - protein, 323 aa, Artificial Sequence
  CD155 v1 ECD
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 346 - protein, 323 aa, Artificial Sequence
  CD155 v2 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 347 - protein, 323 aa, Artificial Sequence
  CD155 v3 ECD
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 348 - protein, 323 aa, Artificial Sequence
  CD155 v4 ECD
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 349 - protein, 323 aa, Artificial Sequence
  CD155 v5 ECD
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 350 - protein, 323 aa, Artificial Sequence
  CD155 v6 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 351 - protein, 323 aa, Artificial Sequence
  CD155 v7 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 352 - protein, 323 aa, Artificial Sequence
  CD155 v8 ECD
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 353 - protein, 323 aa, Artificial Sequence
  CD155 v9 ECD
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 354 - protein, 323 aa, Artificial Sequence
  CD155 v10 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 355 - protein, 323 aa, Artificial Sequence
  CD155 v11 ECD
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 356 - protein, 323 aa, Artificial Sequence
  CD155 v12 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 357 - protein, 323 aa, Artificial Sequence
  CD155 v14 ECD
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 358 - protein, 323 aa, Artificial Sequence
  CD155 v15 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 359 - protein, 323 aa, Artificial Sequence
  CD155 v16 ECD
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 360 - protein, 323 aa, Artificial Sequence
  CD155 v17 ECD
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 361 - protein, 323 aa, Artificial Sequence
  CD155 v18 ECD
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 362 - protein, 323 aa, Artificial Sequence
  CD155 v19 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 363 - protein, 323 aa, Artificial Sequence
  CD155 v20 ECD
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 364 - protein, 323 aa, Artificial Sequence
  CD155 v21 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 365 - protein, 323 aa, Artificial Sequence
  CD155 v22 ECD
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 366 - protein, 116 aa, Artificial Sequence
  CD155 v1 IgV
PGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWL

SEQ ID NO: 367 - protein, 116 aa, Artificial Sequence
  CD155 v2 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWL

SEQ ID NO: 368 - protein, 116 aa, Artificial Sequence
  CD155 v3 IgV
PGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWL

SEQ ID NO: 369 - protein, 116 aa, Artificial Sequence
  CD155 v4 IgV
PGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWL

SEQ ID NO: 370 - protein, 116 aa, Artificial Sequence
  CD155 v5 IgV
PGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWL

SEQ ID NO: 371 - protein, 116 aa, Artificial Sequence
  CD155 v6 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 372 - protein, 116 aa, Artificial Sequence
  CD155 v7 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 373 - protein, 116 aa, Artificial Sequence
  CD155 v8 IgV
PGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWL

SEQ ID NO: 374 - protein, 116 aa, Artificial Sequence
  CD155 v9 IgV
PGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 375 - protein, 116 aa, Artificial Sequence
  CD155 v10 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWL

SEQ ID NO: 376 - protein, 116 aa, Artificial Sequence
  CD155 v11 IgV
PGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWL

SEQ ID NO: 377 - protein, 116 aa, Artificial Sequence
  CD155 v12 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWL

SEQ ID NO: 378 - protein, 116 aa, Artificial Sequence
  CD155 v14 IgV
PGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWL

SEQ ID NO: 379 - protein, 116 aa, Artificial Sequence
  CD155 v15 IgV
PGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWL

SEQ ID NO: 380 - protein, 116 aa, Artificial Sequence
  CD155 v16 IgV
PGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 381 - protein, 116 aa, Artificial Sequence
  CD155 v17 IgV
PGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWL

SEQ ID NO: 382 - protein, 116 aa, Artificial Sequence
  CD155 v18 IgV
PGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWL

SEQ ID NO: 383 - protein, 116 aa, Artificial Sequence
  CD155 v19 IgV
PGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWL

SEQ ID NO: 384 - protein, 116 aa, Artificial Sequence
  CD155 v20 IgV
PGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWL

SEQ ID NO: 385 - protein, 116 aa, Artificial Sequence
  CD155 v21 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWL

SEQ ID NO: 386 - protein, 116 aa, Artificial Sequence
  CD155 v22 IgV
PGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWL

SEQ ID NO: 387 - protein, 122 aa, Homo sapiens
  MISC_FEATURE: CD155 IgV wildtype
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVL

SEQ ID NO: 388 - protein, 122 aa, Artificial Sequence
  CD155 v1 IgV
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVL

SEQ ID NO: 389 - protein, 122 aa, Artificial Sequence
  CD155 v2 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVL

SEQ ID NO: 390 - protein, 122 aa, Artificial Sequence
  CD155 v3 IgV
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVL

SEQ ID NO: 391 - protein, 122 aa, Artificial Sequence
  CD155 v4 IgV
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVL

SEQ ID NO: 392 - protein, 122 aa, Artificial Sequence
  CD155 v5 IgV
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVL

SEQ ID NO: 393 - protein, 122 aa, Artificial Sequence
  CD155 v6 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 394 - protein, 122 aa, Artificial Sequence
  CD155 v7 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 395 - protein, 122 aa, Artificial Sequence
  CD155 v8 IgV
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVL

SEQ ID NO: 396 - protein, 122 aa, Artificial Sequence
  CD155 v9 IgV
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 397 - protein, 122 aa, Artificial Sequence
  CD155 v10 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVL

SEQ ID NO: 398 - protein, 122 aa, Artificial Sequence
  CD155 v11 IgV
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVL

SEQ ID NO: 399 - protein, 122 aa, Artificial Sequence
  CD155 v12 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVL

SEQ ID NO: 400 - protein, 122 aa, Artificial Sequence
  CD155 v14 IgV
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVL

SEQ ID NO: 401 - protein, 122 aa, Artificial Sequence
  CD155 v15 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVL

SEQ ID NO: 402 - protein, 122 aa, Artificial Sequence
  CD155 v16 IgV
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 403 - protein, 122 aa, Artificial Sequence
  CD155 v17 IgV
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVL

SEQ ID NO: 404 - protein, 122 aa, Artificial Sequence
  CD155 v18 IgV
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVL

SEQ ID NO: 405 - protein, 122 aa, Artificial Sequence
  CD155 v19 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVL

SEQ ID NO: 406 - protein, 122 aa, Artificial Sequence
  CD155 v20 IgV
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVL

SEQ ID NO: 407 - protein, 122 aa, Artificial Sequence
  CD155 v21 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVL

SEQ ID NO: 408 - protein, 122 aa, Artificial Sequence
  CD155 v22 IgV
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVL

SEQ ID NO: 409 - protein, 323 aa, Artificial Sequence
  CD155 v23 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 410 - protein, 323 aa, Artificial Sequence
  CD155 v24 ECD
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 411 - protein, 323 aa, Artificial Sequence
  CD155 v25 ECD
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 412 - protein, 323 aa, Artificial Sequence
  CD155 v26 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 413 - protein, 323 aa, Artificial Sequence
  CD155 v27 ECD
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 414 - protein, 323 aa, Artificial Sequence
  CD155 v28 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 415 - protein, 323 aa, Artificial Seqeunce
  CD155 v39 ECD
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 416 - protein, 323 aa, Artificial Sequence
  CD155 v30 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 417 - protein, 323 aa, Artificial Sequence
  CD155 v31 ECD
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 418 - protein, 323 aa, Artificial Sequence
  CD155 v32 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 419 - protein, 323 aa, Artificial Sequence
  CD155 v33 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 420 - protein, 323 aa, Artificial Sequence
  CD155 v34 ECD
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 421 - protein, 323 aa, Artificial Sequence
  CD155 v35 ECD
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 422 - protein, 323 aa, Artificial Sequence
  CD155 v36 ECD
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 423 - protein, 323 aa, Artificial Sequence
  CD155 v37 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 424 - protein, 323 aa, Artificial Sequence
  CD155 v38 ECD
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 425 - protein, 323 aa, Artificial Sequence
  CD155 v39 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 426 - protein, 323 aa, Artificial Sequence
  CD155 v40 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 427 - protein, 323 aa, Artificial Sequence
  CD155 v41 ECD
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 428 - protein, 323 aa, Artificial Sequence
  CD155 v42 ECD
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 429 - protein, 323 aa, Artificial Sequence
  CD155 v43 ECD
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 430 - protein, 323 aa, Artificial Sequence
  CD155 v44 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 431 - protein, 323 aa, Artificial Sequence
  CD155 v45 ECD
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 432 - protein, 323 aa, Artificial Sequence
  CD155 v46 ECD
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 433 - protein, 323 aa, Artificial Sequence
  CD155 v47 ECD
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 434 - protein, 323 aa, Artificial Sequence
  CD155 v48 ECD
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 435 - protein, 323 aa, Artificial Sequence
  CD155 v49 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 436 - protein, 323 aa, Artificial Sequence
  CD155 v50 ECD
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 437 - protein, 323 aa, Artificial Sequence
  CD155 v51 ECD
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 438 - protein, 323 aa, Artificial Sequence
  CD155 v52 ECD
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 439 - protein, 323 aa, Artificial Sequence
  CD155 v53 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 440 - protein, 323 aa, Artificial Sequence
  CD155 v54 ECD
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 441 - protein, 323 aa, Artificial Sequence
  CD155 v55 ECD
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 442 - protein, 323 aa, Artificial Sequence
  CD155 v56 ECD
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 443 - protein, 323 aa, Artificial Sequence
  CD155 v57 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 444 - protein, 323 aa, Artificial Sequence
  CD155 v58 ECD
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 445 - protein, 323 aa, Artificial Sequence
  CD155 v59 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 446 - protein, 323 aa, Artificial Sequence
  CD155 v60 ECD
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 447 - protein, 323 aa, Artificial Sequence
  CD155 v61 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 448 - protein, 323 aa, Artificial Sequence
  CD155 v62 ECD
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 449 - protein, 323 aa, Artificial Sequence
  CD155 v63 ECD
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 450 - protein, 323 aa, Artificial Sequence
  CD155 v64 ECD
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 451 - protein, 323 aa, Artificial Sequence
  CD155 v65 ECD
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 452 - protein, 323 aa, Artificial Sequence
  CD155 v66 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 453 - protein, 323 aa, Artificial Sequence
  CD155 v67 ECD
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 454 - protein, 323 aa, Artificial Sequence
  CD155 v68 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 455 - protein, 323 aa, Artificial Sequence
  CD155 v69 ECD
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 456 - protein, 323 aa, Artificial Sequence
  CD155 v70 ECD
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 457 - protein, 323 aa, Artificial Sequence
  CD155 v71 ECD
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 458 - protein, 323 aa, Artificial Sequence
  CD155 v72 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 459 - protein, 323 aa, Artificial Sequence
  CD155 v73 ECD
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 460 - protein, 323 aa, Artificial Sequence
  CD155 v74 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 461 - protein, 323 aa, Artificial Sequence
  CD155 v75 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 462 - protein, 323 aa, Artificial Sequence
  CD155 v76 ECD
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 463 - protein, 323 aa, Artificial Sequence
  CD155 v77 ECD
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 464 - protein, 323 aa, Artificial Sequence
  CD155 v78 ECD
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 465 - protein, 323 aa, Artificial Sequence
  CD155 v79 ECD
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 466 - protein, 323 aa, Artificial Sequence
  CD155 v80 ECD
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 467 - protein, 323 aa, Artificial Sequence
  CD155 v81 ECD
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 468 - protein, 323 aa, Artificial Sequence
  CD155 v82 ECD
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 469 - protein, 323 aa, Artificial Sequence
  CD155 v83 ECD
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 470 - protein, 323 aa, Artificial Sequence
  CD155 v84 ECD
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 471 - protein, 323 aa, Artificial Sequence
  CD155 v85 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 472 - protein, 323 aa, Artificial Sequence
  CD155 v86 ECD
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 473 - protein, 323 aa, Artificial Sequence
  CD155 v87 ECD
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 474 - protein, 323 aa, Artificial Sequence
  CD155 v88 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 475 - protein, 323 aa, Artificial Sequence
  CD155 v89 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 476 - protein, 323 aa, Artificial Sequence
  CD155 v90 ECD
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 477 - protein, 323 aa, Artificial Sequence
  CD155 v91 ECD
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 478 - protein, 323 aa, Artificial Sequence
  CD155 v92 ECD
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 479 - protein, 323 aa, Artificial Sequence
  CD155 v94 ECD
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 480 - protein, 323 aa, Artificial Sequence
  CD155 v94 ECD
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 481 - protein, 323 aa, Artificial Sequence
  CD155 v94 ECD
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 482 - protein, 323 aa, Artificial Sequence
  CD155 v96 ECD
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 483 - protein, 323 aa, Artificial Sequence
  CD155 v97 ECD
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 484 - protein, 323 aa, Artificial Sequence
  CD155 v98 ECD
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 485 - protein, 323 aa, Artificial Sequence
  CD155 v99 ECD
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 486 - protein, 323 aa, Artificial Sequence
  CD155 v100 ECD
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 487 - protein, 323 aa, Artificial Sequence
  CD155 v101 ECD
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 488 - protein, 323 aa, Artificial Sequence
  CD155 v102 ECD
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 489 - protein, 323 aa, Artificial Sequence
  CD155 v103 ECD
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 490 - protein, 323 aa, Artificial Sequence
  CD155 v104 ECD
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 491 - protein, 323 aa, Artificial Sequence
  CD155 v105 ECD
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 492 - protein, 323 aa, Artificial Sequence
  CD155 v106 ECD
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 493 - protein, 323 aa, Artificial Sequence
  CD155 v107 ECD
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 494 - protein, 323 aa, Artificial Sequence
  CD155 v108 ECD
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 495 - protein, 323 aa, Artificial Sequence
  CD155 v109 ECD
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 496 - protein, 323 aa, Artificial Sequence
  CD155 v110 ECD
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 497 - protein, 323 aa, Artificial Sequence
  CD155 v111 ECD
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 498 - protein, 323 aa, Artificial Sequence
  CD155 v112 ECD
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 499 - protein, 323 aa, Artificial Sequence
  CD155 v113 ECD
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 500 - protein, 323 aa, Artificial Sequence
  CD155 v114 ECD
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 501 - protein, 323 aa, Artificial Sequence
  CD155 v115 ECD
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 502 - protein, 323 aa, Artificial Sequence
  CD155 v116 ECD
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 503 - protein, 323 aa, Artificial Sequence
  CD155 v117 ECD
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 504 - protein, 323 aa, Artificial Sequence
  CD155 v118 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 505 - protein, 323 aa, Artificial Sequence
  CD155 v119 ECD
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 506 - protein, 116 aa, Artificial Sequence
  CD155 v23 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWL

SEQ ID NO: 507 - protein, 116 aa, Artificial Sequence
  CD155 v24 IgV
PGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWL

SEQ ID NO: 508 - protein, 116 aa, Artificial Sequence
  CD155 v25 IgV
PGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWL

SEQ ID NO: 509 - protein, 116 aa, Artificial Sequence
  CD155 v26 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWL

SEQ ID NO: 510 - protein, 119 aa, Artificial Sequence
  CD155 v27 IgV
PGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 511 - protein, 116 aa, Artificial Sequence
  CD155 v28 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWL

SEQ ID NO: 512 - protein, 116 aa, Artificial Sequence
  CD155 v29 IgV
PGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWL

SEQ ID NO: 513 - protein, 116 aa, Artificial Sequence
  CD155 v30 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWL

SEQ ID NO: 514 - protein, 116 aa, Artificial Sequence
  CD155 v31 IgV
PGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWL

SEQ ID NO: 515 - protein, 116 aa, Artificial Sequence
  CD155 v32 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWL

SEQ ID NO: 516 - protein, 116 aa, Artificial Sequence
  CD155 v33 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWL

SEQ ID NO: 517 - protein, 116 aa, Artificial Sequence
  CD155 v34 IgV
PGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWL

SEQ ID NO: 518 - protein, 116 aa, Artificial Sequence
  CD155 v35 IgV
PGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWL

SEQ ID NO: 519 - protein, 116 aa, Artificial Sequence
  CD155 v36 IgV
PGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWL

SEQ ID NO: 520 - protein, 116 aa, Artificial Sequence
  CD155 v37 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWL

SEQ ID NO: 521 - protein, 116 aa, Artificial Sequence
  CD155 v38 IgV
PGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWL

SEQ ID NO: 522 - protein, 116 aa, Artificial Sequence
  CD155 v39 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWL

SEQ ID NO: 523 - protein, 116 aa, Artificial Sequence
  CD155 v40 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWL

SEQ ID NO: 524 - protein, 116 aa, Artificial Sequence
  CD155 v41 IgV
PGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWL

SEQ ID NO: 525 - protein, 116 aa, Artificial Sequence
  CD155 v42 IgV
PGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWL

SEQ ID NO: 526 - protein, 116 aa, Artificial Sequence
  CD155 v43 IgV
PGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWL

SEQ ID NO: 527 - protein, 116 aa, Artificial Sequence
  CD155 v44 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWL

SEQ ID NO: 528 - protein, 116 aa, Artificial Sequence
  CD155 v45 IgV
PGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWL

SEQ ID NO: 529 - protein, 116 aa, Artificial Sequence
  CD155 v46 IgV
PGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWL

SEQ ID NO: 530 - protein, 116 aa, Artificial Sequence
  CD155 v47 IgV
PGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWL

SEQ ID NO: 531 - protein, 116 aa, Artificial Sequence
  CD155 v48 IgV
PGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWL

SEQ ID NO: 532 - protein, 116 aa, Artificial Sequence
  CD155 v49 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWL

SEQ ID NO: 533 - protein, 116 aa, Artificial Sequence
  CD155 v50 IgV
PGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWL

SEQ ID NO: 534 - protein, 116 aa, Artificial Sequence
  CD155 v51 IgV
PGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWL

SEQ ID NO: 535 - protein, 116 aa, Artificial Sequence
  CD155 v52 IgV
PGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWL

SEQ ID NO: 536 - protein, 116 aa, Artificial Sequence
  CD155 v53 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWL

SEQ ID NO: 537 - protein, 116 aa, Artificial Sequence
  CD155 v54 IgV
PGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWL

SEQ ID NO: 538 - protein, 116 aa, Artificial Sequence
  CD155 v55 IgV
PGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWL

SEQ ID NO: 539 - protein, 116 aa, Artificial Sequence
  CD155 v56 IgV
PGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWL

SEQ ID NO: 540 - protein, 116 aa, Artificial Sequence
  CD155 v57 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWL

SEQ ID NO: 541 - protein, 116 aa, Artificial Sequence
  CD155 v58 IgV
PGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWL

SEQ ID NO: 542 - protein, 116 aa, Artificial Sequence
  CD155 v59 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWL

SEQ ID NO: 543 - protein, 116 aa, Artificial Sequence
  CD155 v60 IgV
PGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWL

SEQ ID NO: 544 - protein, 116 aa, Artificial Sequence
  CD155 v61 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWL

SEQ ID NO: 545 - protein, 116 aa, Artificial Sequence
  CD155 v62 IgV
PGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWL

SEQ ID NO: 546 - protein, 116 aa, Artificial Sequence
  CD155 v63 IgV
PGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWL

SEQ ID NO: 547 - protein, 116 aa, Artificial Sequence
  CD155 v64 IgV
PGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWL

SEQ ID NO: 548 - protein, 116 aa, Artificial Sequence
  CD155 v65 IgV
PGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWL

SEQ ID NO: 549 - protein, 116 aa, Artificial Sequence
  CD155 v66 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWL

SEQ ID NO: 550 - protein, 116 aa, Artificial Sequence
  CD155 v67 IgV
PGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWL

SEQ ID NO: 551 - protein, 116 aa, Artificial Sequence
  CD155 v68 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWL

SEQ ID NO: 552 - protein, 116 aa, Artificial Sequence
  CD155 v69 IgV
PGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 553 - protein, 116 aa, Artificial Sequence
  CD155 v70 IgV
PGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWL

SEQ ID NO: 554 - protein, 116 aa, Artificial Sequence
  CD155 v71 IgV
PGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWL

SEQ ID NO: 555 - protein, 116 aa, Artificial Sequence
  CD155 v72 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 556 - protein, 116 aa, Artificial Sequence
  CD155 v73 IgV
PGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWL

SEQ ID NO: 557 - protein, 116 aa, Artificial Sequence
  CD155 v74 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 558 - protein, 116 aa, Artificial Sequence
  CD155 v75 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWL

SEQ ID NO: 559 - protein, 116 aa, Artificial Sequence
  CD155 v76 IgV
PGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 560 - protein, 116 aa, Artificial Sequence
  CD155 v77 IgV
PGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWL

SEQ ID NO: 561 - protein, 116 aa, Artificial Sequence
  CD155 v78 IgV
PGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWL

SEQ ID NO: 562 - protein, 116 aa, Artificial Sequence
  CD155 v79 IgV
PGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWL

SEQ ID NO: 563 - protein, 116 aa, Artificial Sequence
  CD155 v80 IgV
PGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWL

SEQ ID NO: 564 - protein, 116 aa, Artificial Sequence
  CD155 v81 IgV
PGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWL

SEQ ID NO: 565 - protein, 116 aa, Artificial Sequence
  CD155 v82 IgV
PGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWL

SEQ ID NO: 566 - protein, 116 aa, Artificial Sequence
  CD155 v83 IgV
PGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWL

SEQ ID NO: 567 - protein, 116 aa, Artificial Sequence
  CD155 v84 IgV
PGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWL

SEQ ID NO: 568 - protein, 116 aa, Artificial Sequence
  CD155 v85 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWL

SEQ ID NO: 569 - protein, 116 aa, Artificial Sequence
  CD155 v86 IgV
PGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWL

SEQ ID NO: 570 - protein, 116 aa, Artificial Sequence
  CD155 v87 IgV
PGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWL

SEQ ID NO: 571 - protein, 116 aa, Artificial Sequence
  CD155 v88 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWL

SEQ ID NO: 572 - protein, 116 aa, Artificial Sequence
  CD155 v89 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWL

SEQ ID NO: 573 - protein, 116 aa, Artificial Sequence
  CD155 v90 IgV
PGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWL

SEQ ID NO: 574 - protein, 116 aa, Artificial Sequence
  CD155 v91 IgV
PGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWL

SEQ ID NO: 575 - protein, 116 aa, Artificial Sequence
  CD155 v92 IgV
PGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWL

SEQ ID NO: 576 - protein, 116 aa, Artificial Sequence
  CD155 v93 IgV
PGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWL

SEQ ID NO: 577 - protein, 116 aa, Artificial Sequence
  CD155 v94 IgV
PGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWL

SEQ ID NO: 578 - protein, 116 aa, Artificial Sequence
  CD155 v95 IgV
PGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWL

SEQ ID NO: 579 - protein, 116 aa, Artificial Sequence
  CD155 v96 IgV
PGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWL

SEQ ID NO: 580 - protein, 116 aa, Artificial Sequence
  CD155 v97 IgV
PGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWL

SEQ ID NO: 581 - protein, 116 aa, Artificial Sequence
  CD155 v98 IgV
PGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWL

SEQ ID NO: 582 - protein, 116 aa, Artificial Sequence
  CD155 v99 IgV
PGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWL

SEQ ID NO: 583 - protein, 116 aa, Artificial Sequence
  CD155 v100 IgV
PGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWL

SEQ ID NO: 584 - protein, 116 aa, Artificial Sequence
  CD155 v101 IgV
PGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWL

SEQ ID NO: 585 - protein, 116 aa, Artificial Sequence
  CD155 v102 IgV
PGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWL

SEQ ID NO: 586 - protein, 116 aa, Artificial Sequence
  CD155 v103 IgV
PGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWL

SEQ ID NO: 587 - protein, 116 aa, Artificial Sequence
  CD155 v104 IgV
PGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWL

SEQ ID NO: 588 - protein, 116 aa, Artificial Sequence
  CD155 v105 IgV
PGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWL

SEQ ID NO: 589 - protein, 116 aa, Artificial Sequence
  CD155 v106 IgV
PGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWL

SEQ ID NO: 590 - protein, 116 aa, Artificial Sequence
  CD155 v107 IgV
PGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWL

SEQ ID NO: 591 - protein, 116 aa, Artificial Sequence
  CD155 v108 IgV
PGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWL

SEQ ID NO: 592 - protein, 116 aa, Artificial Sequence
  CD155 v109 IgV
PGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWL

SEQ ID NO: 593 - protein, 116 aa, Artificial Sequence
  CD155 v110 IgV
PGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWL

SEQ ID NO: 594 - protein, 116 aa, Artificial Sequence
  CD155 v111 IgV
PGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWL

SEQ ID NO: 595 - protein, 116 aa, Artificial Sequence
  CD155 v112 IgV
PGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWL

SEQ ID NO: 596 - protein, 116 aa, Artificial Sequence
  CD155 v113 IgV
PGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWL

SEQ ID NO: 597 - protein, 116 aa, Artificial Sequence
  CD155 v114 IgV
PGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWL

SEQ ID NO: 598 - protein, 116 aa, Artificial Sequence
  CD155 v115 IgV
PGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWL

SEQ ID NO: 599 - protein, 116 aa, Artificial Sequence
  CD155 v116 IgV
PGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWL

SEQ ID NO: 600 - protein, 116 aa, Artificial Sequence
  CD155 v117 IgV
PGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWL

SEQ ID NO: 601 - protein, 116 aa, Artificial Sequence
  CD155 v118 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWL

SEQ ID NO: 602 - protein, 116 aa, Artificial Sequence
  CD155 v119 IgV
PGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWL

SEQ ID NO: 603 - protein, 122 aa, Artificial Sequence
  CD155 v23 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVL

SEQ ID NO: 604 - protein, 122 aa, Artificial Sequence
  CD155 v24 IgV
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVL

SEQ ID NO: 605 - protein, 122 aa, Artificial Sequence
  CD155 v25 IgV
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVL

SEQ ID NO: 606 - protein, 122 aa, Artificial Sequence
  CD155 v26 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVL

SEQ ID NO: 607 - protein, 122 aa, Artificial Sequence
  CD155 v27 IgV
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 608 - protein, 122 aa, Artificial Sequence
  CD155 v28 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVL

SEQ ID NO: 609 - protein, 122 aa, Artificial Sequence
  CD155 v29 IgV
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVL

SEQ ID NO: 610 - protein, 122 aa, Artificial Sequence
  CD155 v30 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVL

SEQ ID NO: 611 - protein, 122 aa, Artificial Sequence
  CD155 v31 IgV
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVL

SEQ ID NO: 612 - protein, 122 aa, Artificial Sequence
  CD155 v32 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVL

SEQ ID NO: 613 - protein, 122 aa, Artificial Sequence
  CD155 v33 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVL

SEQ ID NO: 614 - protein, 122 aa, Artificial Sequence
  CD155 v34 IgV
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVL

SEQ ID NO: 615 - protein, 122 aa, Artificial Sequence
  CD155 v35 IgV
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVL

SEQ ID NO: 616 - protein, 122 aa, Artificial Sequence
  CD155 v36 IgV
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVL

SEQ ID NO: 617 - protein, 122 aa, Artificial Sequence
  CD155 v37 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVL

SEQ ID NO: 618 - protein, 122 aa, Artificial Sequence
  CD155 v38 IgV
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVL

SEQ ID NO: 619 - protein, 122 aa, Artificial Sequence
  CD155 v39 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVL

SEQ ID NO: 620 - protein, 122 aa, Artificial Sequence
  CD155 v40 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVL

SEQ ID NO: 621 - protein, 122 aa, Artificial Sequence
  CD155 v41 IgV
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVL

SEQ ID NO: 622 - protein, 122 aa, Artificial Sequence
  CD155 v42 IgV
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVL

SEQ ID NO: 623 - protein, 122 aa, Artificial Sequence
  CD155 v43 IgV
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVL

SEQ ID NO: 624 - protein, 122 aa, Artificial Sequence
  CD155 v44 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVL

SEQ ID NO: 625 - protein, 122 aa, Artificial Sequence
  CD155 v45 IgV
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVL

SEQ ID NO: 626 - protein, 122 aa, Artificial Sequence
  CD155 v46 IgV
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVL

SEQ ID NO: 627 - protein, 122 aa, Artificial Sequence
  CD155 v47 IgV
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVL

SEQ ID NO: 628 - protein, 122 aa, Artificial Sequence
  CD155 v48 IgV
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVL

SEQ ID NO: 629 - protein, 122 aa, Artificial Sequence
  CD155 v49 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVL

SEQ ID NO: 630 - protein, 122 aa, Artificial Sequence
  CD155 v50 IgV
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVL

SEQ ID NO: 631 - protein, 122 aa, Artificial Sequence
  CD155 v51 IgV
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVL

SEQ ID NO: 632 - protein, 122 aa, Artificial Sequence
  CD155 v52 IgV
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVL

SEQ ID NO: 633 - protein, 122 aa, Artificial Sequence
  CD155 v53 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVL

SEQ ID NO: 634 - protein, 122 aa, Artificial Sequence
  CD155 v54 IgV
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVL

SEQ ID NO: 635 - protein, 122 aa, Artificial Sequence
  CD155 v55 IgV
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVL

SEQ ID NO: 636 - protein, 122 aa, Artificial Sequence
  CD155 v56 IgV
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVL

SEQ ID NO: 637 - protein, 122 aa, Artificial Sequence
  CD155 v57 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVL

SEQ ID NO: 638 - protein, 122 aa, Artificial Sequence
  CD155 v58 IgV
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVL

SEQ ID NO: 639 - protein, 122 aa, Artificial Sequence
  CD155 v59 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVL

SEQ ID NO: 640 - protein, 122 aa, Artificial Sequence
  CD155 v60 IgV
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVL

SEQ ID NO: 641 - protein, 122 aa, Artificial Sequence
  CD155 v61 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVL

SEQ ID NO: 642 - protein, 122 aa, Artificial Sequence
  CD155 v62 IgV
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVL

SEQ ID NO: 643 - protein, 122 aa, Artificial Sequence
  CD155 v63 IgV
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVL

SEQ ID NO: 644 - protein, 122 aa, Artificial Sequence
  CD155 v64 IgV
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVL

SEQ ID NO: 645 - protein, 122 aa, Artificial Sequence
  CD155 v65 IgV
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVL

SEQ ID NO: 646 - protein, 122 aa, Artificial Sequence
  CD155 v66 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVL

SEQ ID NO: 647 - protein, 122 aa, Artificial Sequence
  CD155 v67 IgV
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVL

SEQ ID NO: 648 - protein, 122 aa, Artificial Sequence
  CD155 v68 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVL

SEQ ID NO: 649 - protein, 122 aa, Artificial Sequence
  CD155 v69 IgV
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 650 - protein, 122 aa, Artificial Sequence
  CD155 v70 IgV
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVL

SEQ ID NO: 651 - protein, 122 aa, Artificial Sequence
  CD155 v71 IgV
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVL

SEQ ID NO: 652 - protein, 122 aa, Artificial Sequence
  CD155 v72 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 653 - protein, 122 aa, Artificial Sequence
  CD155 v73 IgV
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVL

SEQ ID NO: 654 - protein, 122 aa, Artificial Sequence
  CD155 v74 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 655 - protein, 122 aa, Artificial Sequence
  CD155 v75 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVL

SEQ ID NO: 656 - protein, 122 aa, Artificial Sequence
  CD155 v76 IgV
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 657 - protein, 122 aa, Artificial Sequence
  CD155 v77 IgV
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVL

SEQ ID NO: 658 - protein, 122 aa, Artificial Sequence
  CD155 v78 IgV
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVL

SEQ ID NO: 659 - protein, 122 aa, Artificial Sequence
  CD155 v79 IgV
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVL

SEQ ID NO: 660 - protein, 122 aa, Artificial Sequence
  CD155 v80 IgV
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVL

SEQ ID NO: 661 - protein, 122 aa, Artificial Sequence
  CD155 v81 IgV
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVL

SEQ ID NO: 662 - protein, 122 aa, Artificial Sequence
  CD155 v82 IgV
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVL

SEQ ID NO: 663 - protein, 122 aa, Artificial Sequence
  CD155 v83 IgV
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVL

SEQ ID NO: 664 - protein, 122 aa, Artificial Sequence
  CD155 v84 IgV
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVL

SEQ ID NO: 665 - protein, 122 aa, Artificial Sequence
  CD155 v85 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVL

SEQ ID NO: 666 - protein, 122 aa, Artificial Sequence
  CD155 v86 IgV
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVL

SEQ ID NO: 667 - protein, 122 aa, Artificial Sequence
  CD155 v87 IgV
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVL

SEQ ID NO: 668 - protein, 122 aa, Artificial Sequence
  CD155 v88 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVL

SEQ ID NO: 669 - protein, 122 aa, Artificial Sequence
  CD155 v89 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVL

SEQ ID NO: 670 - protein, 122 aa, Artificial Sequence
  CD155 v90 IgV
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVL

SEQ ID NO: 671 - protein, 122 aa, Artificial Sequence
  CD155 v91 IgV
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVL

SEQ ID NO: 672 - protein, 122 aa, Artificial Sequence
  CD155 v92 IgV
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVL

SEQ ID NO: 673 - protein, 122 aa, Artificial Sequence
  CD155 v93 IgV
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVL

SEQ ID NO: 674 - protein, 122 aa, Artificial Sequence
  CD155 v94 IgV
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVL

SEQ ID NO: 675 - protein, 122 aa, Artificial Sequence
  CD155 v95 IgV
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVL

SEQ ID NO: 676 - protein, 122 aa, Artificial Sequence
  CD155 v96 IgV
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVL

SEQ ID NO: 677 - protein, 122 aa, Artificial Sequence
  CD155 v97 IgV
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVL

SEQ ID NO: 678 - protein, 122 aa, Artificial Sequence
  CD155 v98 IgV
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVL

SEQ ID NO: 679 - protein, 122 aa, Artificial Sequence
  CD155 v99 IgV
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVL

SEQ ID NO: 680 - protein, 122 aa, Artificial Sequence
  CD155 v100 IgV
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVL

SEQ ID NO: 681 - protein, 122 aa, Artificial Sequence
  CD155 v101 IgV
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVL

SEQ ID NO: 682 - protein, 122 aa, Artificial Sequence
  CD155 v102 IgV
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVL

SEQ ID NO: 683 - protein, 122 aa, Artificial Sequence
  CD155 v103 IgV
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVL

SEQ ID NO: 684 - protein, 122 aa, Artificial Sequence
  CD155 v104 IgV
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVL

SEQ ID NO: 685 - protein, 122 aa, Artificial Sequence
  CD155 v105 IgV
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVL

SEQ ID NO: 686 - protein, 122 aa, Artificial Sequence
  CD155 v106 IgV
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVL

SEQ ID NO: 687 - protein, 122 aa, Artificial Sequence
  CD155 v107 IgV
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVL

SEQ ID NO: 688 - protein, 122 aa, Artificial Sequence
  CD155 v108 IgV
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVL

SEQ ID NO: 689 - protein, 122 aa, Artificial Sequence
  CD155 v109 IgV
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVL

SEQ ID NO: 690 - protein, 122 aa, Artificial Sequence
  CD155 v110 IgV
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVL

SEQ ID NO: 691 - protein, 122 aa, Artificial Sequence
  CD155 v111 IgV
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVL

SEQ ID NO: 692 - protein, 122 aa, Artificial Sequence
  CD155 v112 IgV
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVL

SEQ ID NO: 693 - protein, 122 aa, Artificial Sequence
  CD155 v113 IgV
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVL

SEQ ID NO: 694 - protein, 122 aa, Artificial Sequence
  CD155 v114 IgV
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVL

SEQ ID NO: 695 - protein, 122 aa, Artificial Sequence
  CD155 v115 IgV
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVL

SEQ ID NO: 696 - protein, 122 aa, Artificial Sequence
  CD155 v116 IgV
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVL

SEQ ID NO: 697 - protein, 122 aa, Artificial Sequence
  CD155 v117 IgV
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVL

SEQ ID NO: 698 - protein, 122 aa, Artificial Sequence
  CD155 v118 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVL

SEQ ID NO: 699 - protein, 122 aa, Artificial Sequence
  CD155 v119 IgV
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVL

SEQ ID NO: 700 - protein, 125 aa, Homo sapiens [sequence omitted]

SEQ ID NO: 701 - protein, 329 aa, Artificial Sequence
  CD112 v1 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 702 - protein, 329 aa, Artificial Sequence
  CD112 v2 ECD
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 703 - protein, 329 aa, Artificial Sequence
  CD112 v3 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 704 - protein, 329 aa, Artificial Sequence
  CD112 v4 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 705 - protein, 329 aa, Artificial Sequence
  CD112 v5 ECD
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 706 - protein, 329 aa, Artificial Sequence
  CD112 v6 ECD
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 707 - protein, 329 aa, Artificial Sequence
  CD112 v7 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 708 - protein, 329 aa, Artificial Sequence
  CD112 v8 ECD
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 709 - protein, 329 aa, Artificial Sequence
  CD112 v9 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 710 - protein, 329 aa, Artificial Sequence
  CD112 v10 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 711 - protein, 329 aa, Artificial Sequence
  CD112 v11 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 712 - protein, 329 aa, Artificial Sequence
  CD112 v12 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 713 - protein, 329 aa, Artificial Sequence
  CD112 v13 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 714 - protein, 329 aa, Artificial Sequence
  CD112 v14 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 715 - protein, 329 aa, Artificial Sequence
  CD112 v15 ECD
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 716 - protein, 329 aa, Artificial Sequence
  CD112 v16 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 717 - protein, 329 aa, Artificial Sequence
  CD112 v17 ECD
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 718 - protein, 329 aa, Artificial Sequence
  CD112 v18 ECD
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 719 - protein, 329 aa, Artificial Sequence
  CD112 v19 ECD
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 720 - protein, 329 aa, Artificial Sequence
  CD112 v20 ECD
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 721 - protein, 329 aa, Artificial Sequence
  CD112 v21 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 722 - protein, 329 aa, Artificial Sequence
  CD112 v22 ECD
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 723 - protein, 329 aa, Artificial Sequence
  CD112 v23 ECD
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 724 - protein, 329 aa, Artificial Sequence
  CD112 v24 ECD
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 725 - protein, 329 aa, Artificial Sequence
  CD112 v25 ECD
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 726 - protein, 329 aa, Artificial Sequence
  CD112 v26 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 727 - protein, 329 aa, Artificial Sequence
  CD112 v27 ECD
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 728 - protein, 329 aa, Artificial Sequence
  CD112 v28 ECD
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 729 - protein, 329 aa, Artificial Sequence
  CD112 v29 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 730 - protein, 329 aa, Artificial Sequence
  CD112 v30 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 731 - protein, 329 aa, Artificial Sequence
  CD112 v31 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 732 - protein, 329 aa, Artificial Sequence
  CD112 v32 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 733 - protein, 329 aa, Artificial Sequence
  CD112 v33 ECD
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 734 - protein, 329 aa, Artificial Sequence
  CD112 v34 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 735 - protein, 329 aa, Artificial Sequence
  CD112 v35 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 736 - protein, 329 aa, Artificial Sequence
  CD112 v36 ECD
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 737 - protein, 329 aa, Artificial Sequence
  CD112 v37 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 738 - protein, 329 aa, Artificial Sequence
  CD112 v38 ECD
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 739 - protein, 329 aa, Artificial Sequence
  CD112 v39 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 740 - protein, 329 aa, Artificial Sequence
  CD112 v40 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 741 - protein, 329 aa, Artificial Sequence
  CD112 v41 ECD
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 742 - protein, 329 aa, Artificial Sequence
  CD112 v42 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 743 - protein, 329 aa, Artificial Sequence
  CD112 v43 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 744 - protein, 329 aa, Artificial Sequence
  CD112 v44 ECD
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 745 - protein, 329 aa, Artificial Sequence
  CD112 v45 ECD
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 746 - protein, 329 aa, Artificial Sequence
  CD112 v46 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 747 - protein, 329 aa, Artificial Sequence
  CD112 v47 ECD
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 748 - protein, 125 aa, Artificial Sequence
  CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWL

SEQ ID NO: 749 - protein, 125 aa, Artificial Sequence
  CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWL

SEQ ID NO: 750 - protein, 125 aa, Artificial Sequence
  CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 751 - protein, 125 aa, Artificial Sequence
  CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWL

SEQ ID NO: 752 - protein, 125 aa, Artificial Sequence
  CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 753 - protein, 125 aa, Artificial Sequence
  CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWL

SEQ ID NO: 754 - protein, 125 aa, Artificial Sequence
  CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 755 - protein, 125 aa, Artificial Sequence
  CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWL

SEQ ID NO: 756 - protein, 125 aa, Artificial Sequence
  CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 757 - protein, 125 aa, Artificial Sequence
  CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWL

SEQ ID NO: 758 - protein, 125 aa, Artificial Sequence
  CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWL

SEQ ID NO: 759 - protein, 125 aa, Artificial Sequence
  CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 760 - protein, 125 aa, Artificial Sequence
  CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 761 - protein, 125 aa, Artificial Sequence
  CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWL

SEQ ID NO: 762 - protein, 125 aa, Artificial Sequence
  CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWL

SEQ ID NO: 763 - protein, 125 aa, Artificial Sequence
  CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 764 - protein, 125 aa, Artificial Sequence
  CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 765 - protein, 125 aa, Artificial Sequence
  CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWL

SEQ ID NO: 766 - protein, 125 aa, Artificial Sequence
  CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWL

SEQ ID NO: 767 - protein, 125 aa, Artificial Sequence
  CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWL

SEQ ID NO: 768 - protein, 125 aa, Artificial Sequence
  CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWL

SEQ ID NO: 769 - protein, 125 aa, Artificial Sequence
  CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 770 - protein, 125 aa, Artificial Sequence
  CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWL

SEQ ID NO: 771 - protein, 125 aa, Artificial Sequence
  CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWL

SEQ ID NO: 772 - protein, 125 aa, Artificial Sequence
  CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWL

SEQ ID NO: 773 - protein, 125 aa, Artificial Sequence
  CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 774 - protein, 125 aa, Artificial Sequence
  CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWL

SEQ ID NO: 775 - protein, 125 aa, Artificial Sequence
  CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWL

SEQ ID NO: 776 - protein, 125 aa, Artificial Sequence
  CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 777 - protein, 125 aa, Artificial Sequence
  CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWL

SEQ ID NO: 778 - protein, 125 aa, Artificial Sequence
  CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 779 - protein, 125 aa, Artificial Sequence
  CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 780 - protein, 125 aa, Artificial Sequence
  CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWL

SEQ ID NO: 781 - protein, 125 aa, Artificial Sequence
  CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 782 - protein, 125 aa, Artificial Sequence
  CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWL

SEQ ID NO: 783 - protein, 125 aa, Artificial Sequence
  CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWL

SEQ ID NO: 784 - protein, 125 aa, Artificial Sequence
  CD112 v37 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 785 - protein, 125 aa, Artificial Sequence
  CD112 v38 IgV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 786 - protein, 125 aa, Artificial Sequence
  CD112 v39 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 787 - protein, 125 aa, Artificial Sequence
  CD112 v40 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWL

SEQ ID NO: 788 - protein, 125 aa, Artificial Sequence
  CD112 v41 IgV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWL

SEQ ID NO: 789 - protein, 125 aa, Artificial Sequence
  CD112 v42 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 790 - protein, 125 aa, Artificial Sequence
  CD112 v43 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 791 - protein, 125 aa, Artificial Sequence
  CD112 v44 IgV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWL

SEQ ID NO: 792 - protein, 125 aa, Artificial Sequence
  CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 793 - protein, 125 aa, Artificial Sequence
  CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWL

SEQ ID NO: 794 - protein, 125 aa, Artificial Sequence
  CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWL

SEQ ID NO: 795 - protein, 127 aa, Homo sapiens
  MISC_FEATURE: CD112 IgV Wildtype
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRV

SEQ ID NO: 796 - protein, 127 aa, Artificial Sequence
  CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRV

SEQ ID NO: 797 - protein, 127 aa, Artificial Sequence
  CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRV

SEQ ID NO: 798 - protein, 127 aa, Artificial Sequence
  CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 799 - protein, 127 aa, Artificial Sequence
  CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRV

SEQ ID NO: 800 - protein, 127 aa, Artificial Sequence
  CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 801 - protein, 127 aa, Artificial Sequence
  CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRV

SEQ ID NO: 802 - protein, 127 aa, Artificial Sequence
  CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 803 - protein, 127 aa, Artificial Sequence
  CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRV

SEQ ID NO: 804 - protein, 127 aa, Artificial Sequence
  CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 805 - protein, 127 aa, Artificial Sequence
  CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRV

SEQ ID NO: 806 - protein, 127 aa, Artificial Sequence
  CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRV

SEQ ID NO: 807 - protein, 127 aa, Artificial Sequence
  CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 808 - protein, 127 aa, Artificial Sequence
  CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 809 - protein, 127 aa, Artificial Sequence
  CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRV

SEQ ID NO: 810 - protein, 127 aa, Artificial Sequence
  CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRV

SEQ ID NO: 811 - protein, 127 aa, Artificial Sequence
  CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 812 - protein, 127 aa, Artificial Sequence
  CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 813 - protein, 127 aa, Artificial Sequence
  CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRV

SEQ ID NO: 814 - protein, 127 aa, Artificial Sequence
  CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRV

SEQ ID NO: 815 - protein, 127 aa, Artificial Sequence
  CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 816 - protein, 127 aa, Artificial Sequence
  CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRV

SEQ ID NO: 817 - protein, 127 aa, Artificial Sequence
  CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 818 - protein, 127 aa, Artificial Sequence
  CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRV

SEQ ID NO: 819 - protein, 127 aa, Artificial Sequence
  CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRV

SEQ ID NO: 820 - protein, 127 aa, Artificial Sequence
  CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRV

SEQ ID NO: 821 - protein, 127 aa, Artificial Sequence
  CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 822 - protein, 127 aa, Artificial Sequence
  CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRV

SEQ ID NO: 823 - protein, 127 aa, Artificial Sequence
  CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRV

SEQ ID NO: 824 - protein, 127 aa, Artificial Sequence
  CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 825 - protein, 127 aa, Artificial Sequence
  CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRV

SEQ ID NO: 826 - protein, 127 aa, Artificial Sequence
  CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 827 - protein, 127 aa, Artificial Sequence
  CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 828 - protein, 127 aa, Artificial Sequence
  CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRV

SEQ ID NO: 829 - protein, 127 aa, Artificial Sequence
  CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 830 - protein, 127 aa, Artificial Sequence
  CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRV

SEQ ID NO: 831 - protein, 127 aa, Artificial Sequence
  CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 832 - protein, 127 aa, Artificial Sequence
  CD112 v37 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 833 - protein, 127 aa, Artificial Sequence
  CD112 v38 gV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 834 - protein, 127 aa, Artificial Sequence
  CD112 v39 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 835 - protein, 127 aa, Artificial Sequence
  CD112 v40 gV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRV

SEQ ID NO: 836 - protein, 127 aa, Artificial Sequence
  CD112 v41 gV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRV

SEQ ID NO: 837 - protein, 127 aa, Artificial Sequence
  CD112 v42 gV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 838 - protein, 127 aa, Artificial Sequence
  CD112 v43 gV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 839 - protein, 127 aa, Artificial Sequence
  CD112 v44 gV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRV

SEQ ID NO: 840 - protein, 127 aa, Artificial Sequence
  CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 841 - protein, 127 aa, Artificial Sequence
  CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRV

SEQ ID NO: 842 - protein, 127 aa, Artificial Sequence
  CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRV

SEQ ID NO: 843 - protein, 329 aa, Artificial Sequence
  CD112 v48 ECD
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 844 - protein, 329 aa, Artificial Sequence
  CD112 v49 ECD
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 845 - protein, 329 aa, Artificial Sequence
  CD112 v50 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 846 - protein, 329 aa, Artificial Sequence
  CD112 v51 ECD
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 847 - protein, 329 aa, Artificial Sequence
  CD112 v52 ECD
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 848 - protein, 329 aa, Artificial Sequence
  CD112 v53 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 849 - protein, 329 aa, Artificial Sequence
  CD112 v54 ECD
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 850 - protein, 329 aa, Artificial Sequence
  CD112 v55 ECD
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 851 - protein, 329 aa, Artificial Sequence; identical to SEQ ID NO: 850
  CD112 v56 ECD

SEQ ID NO: 852 - protein, 329 aa, Artificial Sequence
  CD112 v57 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 853 - protein, 329 aa, Artificial Sequence
  CD112 v58 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 854 - protein, 329 aa, Artificial Sequence
  CD112 v59 ECD
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 855 - protein, 329 aa, Artificial Sequence
  CD112 v60 ECD
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 856 - protein, 329 aa, Artificial Sequence
  CD112 v61 ECD
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 857 - protein, 329 aa, Artificial Sequence
  CD112 v62 ECD
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 858 - protein, 329 aa, Artificial Sequence
  CD112 v63 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 859 - protein, 329 aa, Artificial Sequence
  CD112 v64 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 860 - protein, 329 aa, Artificial Sequence
  CD112 v65 ECD
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 861 - protein, 329 aa, Artificial Sequence
  CD112 v66 ECD
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 862 - protein, 329 aa, Artificial Sequence
  CD112 v67 ECD
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 863 - protein, 329 aa, Artificial Sequence
  CD112 v68 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 864 - protein, 329 aa, Artificial Sequence
  CD112 v69 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 865 - protein, 329 aa, Artificial Sequence
  CD112 v70 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 866 - protein, 329 aa, Artificial Sequence
  CD112 v71 ECD
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 867 - protein, 329 aa, Artificial Sequence
  CD112 v72 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 868 - protein, 329 aa, Artificial Sequence
  CD112 v73 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 869 - protein, 329 aa, Artificial Sequence
  CD112 v74 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 870 - protein, 329 aa, Artificial Sequence
  CD112 v75 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 871 - protein, 329 aa, Artificial Sequence
  CD112 v76 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 872 - protein, 329 aa, Artificial Sequence
  CD112 v77 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 873 - protein, 329 aa, Artificial Sequence
  CD112 v78 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 874 - protein, 329 aa, Artificial Sequence
  CD112 v79 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 875 - protein, 329 aa, Artificial Sequence
  CD112 v80 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 876 - protein, 329 aa, Artificial Sequence
  CD112 v81 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 877 - protein, 329 aa, Artificial Sequence
  CD112 v82 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 878 - protein, 329 aa, Artificial Sequence
  CD112 v83 ECD
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 879 - protein, 329 aa, Artificial Sequence
  CD112 v84 ECD
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 880 - protein, 329 aa, Artificial Sequence
  CD112 v85 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 881 - protein, 329 aa, Artificial Sequence
  CD112 v86 ECD
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 882 - protein, 329 aa, Artificial Sequence
  CD112 v87 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 883 - protein, 329 aa, Artificial Sequence
  CD112 v88 ECD
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 884 - protein, 125 aa, Artificial Sequence
  CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWL

SEQ ID NO: 885 - protein, 125 aa, Artificial Sequence
  CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWL

SEQ ID NO: 886 - protein, 125 aa, Artificial Sequence
  CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWL

SEQ ID NO: 887 - protein, 125 aa, Artificial Sequence
  CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWL

SEQ ID NO: 888 - protein, 125 aa, Artificial Sequence
  CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWL

SEQ ID NO: 889 - protein, 125 aa, Artificial Sequence
  CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWL

SEQ ID NO: 890 - protein, 125 aa, Artificial Sequence
  CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 891 - protein, 125 aa, Artificial Sequence
  CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWL

SEQ ID NO: 892 - protein, 125 aa, Artificial Sequence
  CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWL

SEQ ID NO: 893 - protein, 125 aa, Artificial Sequence
  CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 894 - protein, 125 aa, Artificial Sequence
  CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWL

SEQ ID NO: 895 - protein, 125 aa, Artificial Sequence
  CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWL

SEQ ID NO: 896 - protein, 125 aa, Artificial Sequence
  CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWL

SEQ ID NO: 897 - protein, 125 aa, Artificial Sequence
  CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 898 - protein, 125 aa, Artificial Sequence
  CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWL

SEQ ID NO: 899 - protein, 125 aa, Artificial Sequence
  CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 900 - protein, 125 aa, Artificial Sequence
  CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 901 - protein, 125 aa, Artificial Sequence
  CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWL

SEQ ID NO: 902 - protein, 125 aa, Artificial Sequence
  CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWL

SEQ ID NO: 903 - protein, 125 aa, Artificial Sequence
  CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWL

SEQ ID NO: 904 - protein, 125 aa, Artificial Sequence
  CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 905 - protein, 125 aa, Artificial Sequence
  CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWL

SEQ ID NO: 906 - protein, 125 aa, Artificial Sequence
  CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 907 - protein, 125 aa, Artificial Sequence
  CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWL

SEQ ID NO: 908 - protein, 125 aa, Artificial Sequence
  CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWL

SEQ ID NO: 909 - protein, 125 aa, Artificial Sequence
  CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWL

SEQ ID NO: 910 - protein, 125 aa, Artificial Sequence
  CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 911 - protein, 125 aa, Artificial Sequence
  CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWL

SEQ ID NO: 912 - protein, 125 aa, Artificial Sequence
  CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWL

SEQ ID NO: 913 - protein, 125 aa, Artificial Sequence
  CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWL

SEQ ID NO: 914 - protein, 125 aa, Artificial Sequence
  CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 915 - protein, 125 aa, Artificial Sequence
  CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWL

SEQ ID NO: 916 - protein, 125 aa, Artificial Sequence
  CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 917 - protein, 125 aa, Artificial Sequence
  CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 918 - protein, 125 aa, Artificial Sequence
  CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWL

SEQ ID NO: 919 - protein, 125 aa, Artificial Sequence
  CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWL

SEQ ID NO: 920 - protein, 125 aa, Artificial Sequence
  CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWL

SEQ ID NO: 921 - protein, 125 aa, Artificial Sequence
  CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWL

SEQ ID NO: 922 - protein, 125 aa, Artificial Sequence
  CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWL

SEQ ID NO: 923 - protein, 125 aa, Artificial Sequence
  CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWL

SEQ ID NO: 924 - protein, 125 aa, Artificial Sequence
  CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWL

SEQ ID NO: 925 - protein, 127 aa, Artificial Sequence
  CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRV

SEQ ID NO: 926 - protein, 127 aa, Artificial Sequence
  CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRV

SEQ ID NO: 927 - protein, 127 aa, Artificial Sequence
  CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRV

SEQ ID NO: 928 - protein, 127 aa, Artificial Sequence
  CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRV

SEQ ID NO: 929 - protein, 127 aa, Artificial Sequence
  CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRV

SEQ ID NO: 930 - protein, 127 aa, Artificial Sequence
  CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRV

SEQ ID NO: 931 - protein, 127 aa, Artificial Sequence
  CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 932 - protein, 127 aa, Artificial Sequence
  CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRV

SEQ ID NO: 933 - protein, 127 aa, Artificial Sequence
  CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWLRV

SEQ ID NO: 934 - protein, 127 aa, Artificial Sequence
  CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 935 - protein, 127 aa, Artificial Sequence
  CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRV

SEQ ID NO: 936 - protein, 127 aa, Artificial Sequence
  CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRV

SEQ ID NO: 937 - protein, 127 aa, Artificial Sequence
  CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRV

SEQ ID NO: 938 - protein, 127 aa, Artificial Sequence
  CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 939 - protein, 127 aa, Artificial Sequence
  CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRV

SEQ ID NO: 940 - protein, 127 aa, Artificial Sequence
  CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 941 - protein, 127 aa, Artificial Sequence
  CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 942 - protein, 127 aa, Artificial Sequence
  CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRV

SEQ ID NO: 943 - protein, 127 aa, Artificial Sequence
  CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRV

SEQ ID NO: 944 - protein, 127 aa, Artificial Sequence
  CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRV

SEQ ID NO: 945 - protein, 127 aa, Artificial Sequence
  CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 946 - protein, 127 aa, Artificial Sequence
  CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRV

SEQ ID NO: 947 - protein, 127 aa, Artificial Sequence
  CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 948 - protein, 127 aa, Artificial Sequence
  CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRV

SEQ ID NO: 949 - protein, 127 aa, Artificial Sequence
  CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRV

SEQ ID NO: 950 - protein, 127 aa, Artificial Sequence
  CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRV

SEQ ID NO: 951 - protein, 127 aa, Artificial Sequence
  CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 952 - protein, 127 aa, Artificial Sequence
  CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRV

SEQ ID NO: 953 - protein, 127 aa, Artificial Sequence
  CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRV

SEQ ID NO: 954 - protein, 127 aa, Artificial Sequence
  CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRV

SEQ ID NO: 955 - protein, 127 aa, Artificial Sequence
  CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 956 - protein, 127 aa, Artificial Sequence
  CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRV

SEQ ID NO: 957 - protein, 127 aa, Artificial Sequence
  CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 958 - protein, 127 aa, Artificial Sequence
  CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 959 - protein, 127 aa, Artificial Sequence
  CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRV

SEQ ID NO: 960 - protein, 127 aa, Artificial Sequence
  CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRV

SEQ ID NO: 961 - protein, 127 aa, Artificial Sequence
  CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRV

SEQ ID NO: 962 - protein, 127 aa, Artificial Sequence
  CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRV

SEQ ID NO: 963 - protein, 127 aa, Artificial Sequence
  CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRV

SEQ ID NO: 964 - protein, 127 aa, Artificial Sequence
  CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRV

SEQ ID NO: 965 - protein, 127 aa, Artificial Sequence
  CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRV

SEQ ID NO: 966 - protein, 208 aa, Artificial Sequence
  CD80 v122 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 967 - protein, 208 aa, Artificial Sequence
  CD80 v123 ECD
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 968 - protein, 208 aa, Artificial Sequence
  CD80 v124 ECD
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 969 - protein, 208 aa, Artificial Sequence
  CD80 v125 ECD
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 970 - protein, 208 aa, Artificial Sequence
  CD80 v126 ECD
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 971 - protein, 208 aa, Artificial Sequence
  CD80 v127 ECD
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 972 - protein, 208 aa, Artificial Sequence
  CD80 v128 ECD
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 973 - protein, 208 aa, Artificial Sequence
  CD80 v130 ECD
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 974 - protein, 208 aa, Artificial Sequence
  CD80 v131 ECD
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 975 - protein, 208 aa, Artificial Sequence
  CD80 v132 ECD
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 976 - protein, 208 aa, Artificial Sequence
  CD80 v133 ECD
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 977 - protein, 208 aa, Artificial Sequence
  CD80 v134 ECD
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 978 - protein, 208 aa, Artificial Sequence
  CD80 v135 ECD
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 979 - protein, 208 aa, Artificial Sequence
  CD80 v136 ECD
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 980 - protein, 208 aa, Artificial Sequence
  CD80 v137 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 981 - protein, 208 aa, Artificial Sequence
  CD80 v138 ECD
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 982 - protein, 208 aa, Artificial Sequence
  CD80 v139 ECD
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 983 - protein, 208 aa, Artificial Sequence
  CD80 v140 ECD
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 984 - protein, 208 aa, Artificial Sequence
  CD80 v141 ECD
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 985 - protein, 208 aa, Artificial Sequence
  CD80 v142 ECD
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 986 - protein, 208 aa, Artificial Sequence
  CD80 v143 ECD
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 987 - protein, 208 aa, Artificial Sequence
  CD80 v144 ECD
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 988 - protein, 208 aa, Artificial Sequence
  CD80 v145 ECD
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 989 - protein, 208 aa, Artificial Sequence
  CD80 v146 ECD
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 990 - protein, 208 aa, Artificial Sequence
  CD80 v147 ECD
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 991 - protein, 208 aa, Artificial Sequence
  CD80 v148 ECD
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 992 - protein, 208 aa, Artificial Sequence
  CD80 v149 ECD
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 993 - protein, 208 aa, Artificial Sequence
  CD80 v150 ECD
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 994 - protein, 208 aa, Artificial Sequence
  CD80 v151 ECD
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 995 - protein, 208 aa, Artificial Sequence
  CD80 v152 ECD
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 996 - protein, 208 aa, Artificial Sequence
  CD80 v153 ECD
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 997 - protein, 208 aa, Artificial Sequence
  CD80 v154 ECD
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 998 - protein, 208 aa, Artificial Sequence
  CD80 v155 ECD
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 999 - protein, 208 aa, Artificial Sequence
  CD80 v156 ECD
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1000 - protein, 208 aa, Artificial Sequence
  CD80 v157 ECD
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1001 - protein, 208 aa, Artificial Sequence
  CD80 v158 ECD
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1002 - protein, 208 aa, Artificial Sequence
  CD80 v159 ECD
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1003 - protein, 208 aa, Artificial Sequence
  CD80 v160 ECD
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1004 - protein, 208 aa, Artificial Sequence
  CD80 v161 ECD
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1005 - protein, 208 aa, Artificial Sequence
  CD80 v162 ECD
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1006 - protein, 208 aa, Artificial Sequence
  CD80 v163 ECD
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1007 - protein, 208 aa, Artificial Sequence
  CD80 v164 ECD
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1008 - protein, 208 aa, Artificial Sequence
  CD80 v165 ECD
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1009 - protein, 208 aa, Artificial Sequence; identical to SEQ ID NO: 991
  CD80 v166 ECD

SEQ ID NO: 1010 - protein, 208 aa, Artificial Sequence
  CD80 v167 ECD
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1011 - protein, 208 aa, Artificial Sequence
  CD80 v168 ECD
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1012 - protein, 208 aa, Artificial Sequence
  CD80 v169 ECD
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1013 - protein, 208 aa, Artificial Sequence
  CD80 v170 ECD
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1014 - protein, 208 aa, Artificial Sequence
  CD80 v171 ECD
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1015 - protein, 208 aa, Artificial Sequence
  CD80 v172 ECD
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1016 - protein, 208 aa, Artificial Sequence
  CD80 v173 ECD
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1017 - protein, 208 aa, Artificial Sequence
  CD80 v174 ECD
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1018 - protein, 208 aa, Artificial Sequence
  CD80 v175 ECD
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1019 - protein, 208 aa, Artificial Sequence
  CD80 v176 ECD
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1020 - protein, 208 aa, Artificial Sequence
  CD80 v177 ECD
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1021 - protein, 208 aa, Artificial Sequence
  CD80 v178 ECD
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1022 - protein, 208 aa, Artificial Sequence
  CD80 v179 ECD
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1023 - protein, 208 aa, Artificial Sequence
  CD80 v180 ECD
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1024 - protein, 208 aa, Artificial Sequence
  CD80 v181 ECD
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1025 - protein, 208 aa, Artificial Sequence
  CD80 v182 ECD
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1026 - protein, 208 aa, Artificial Sequence
  CD80 v183 ECD
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1027 - protein, 208 aa, Artificial Sequence
  CD80 v184 ECD
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1028 - protein, 208 aa, Artificial Sequence
  CD80 v185 ECD
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1029 - protein, 208 aa, Artificial Sequence
  CD80 v186 ECD
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1030 - protein, 208 aa, Artificial Sequence
  CD80 v187 ECD
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1031 - protein, 208 aa, Artificial Sequence
  CD80 v188 ECD
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1032 - protein, 208 aa, Artificial Sequence
  CD80 v189 ECD
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1033 - protein, 208 aa, Artificial Sequence
  CD80 v190 ECD
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1034 - protein, 208 aa, Artificial Sequence
  CD80 v191 ECD
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1035 - protein, 208 aa, Artificial Sequence
  CD80 v192 ECD
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1036 - protein, 208 aa, Artificial Sequence
  CD80 v193 ECD
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1037 - protein, 208 aa, Artificial Sequence
  CD80 v194 ECD
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1038 - protein, 208 aa, Artificial Sequence
  CD80 v195 ECD
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 1039 - protein, 101 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVT

SEQ ID NO: 1040 - protein, 101 aa, Artificial Sequence
  CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVT

SEQ ID NO: 1041 - protein, 101 aa, Artificial Sequence
  CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVT

SEQ ID NO: 1042 - protein, 101 aa, Artificial Sequence
  CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVT

SEQ ID NO: 1043 - protein, 101 aa, Artificial Sequence
  CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVT

SEQ ID NO: 1044 - protein, 101 aa, Artificial Sequence
  CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 1045 - protein, 101 aa, Artificial Sequence
  CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVT

SEQ ID NO: 1046 - protein, 101 aa, Artificial Sequence
  CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVT

SEQ ID NO: 1047 - protein, 101 aa, Artificial Sequence
  CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVT

SEQ ID NO: 1048 - protein, 101 aa, Artificial Sequence
  CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVT

SEQ ID NO: 1049 - protein, 101 aa, Artificial Sequence
  CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVT

SEQ ID NO: 1050 - protein, 101 aa, Artificial Sequence
  CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVT

SEQ ID NO: 1051 - protein, 101 aa, Artificial Sequence
  CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVT

SEQ ID NO: 1052 - protein, 101 aa, Artificial Sequence
  CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVT

SEQ ID NO: 1053 - protein, 101 aa, Artificial Sequence
  CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVT

SEQ ID NO: 1054 - protein, 101 aa, Artificial Sequence
  CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVT

SEQ ID NO: 1055 - protein, 101 aa, Artificial Sequence
  CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVT

SEQ ID NO: 1056 - protein, 101 aa, Artificial Sequence
  CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVT

SEQ ID NO: 1057 - protein, 101 aa, Artificial Sequence
  CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVT

SEQ ID NO: 1058 - protein, 101 aa, Artificial Sequence
  CD80 v141 IgV
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVT

SEQ ID NO: 1059 - protein, 101 aa, Artificial Sequence
  CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVT

SEQ ID NO: 1060 - protein, 101 aa, Artificial Sequence
  CD80 v143 IgV
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVT

SEQ ID NO: 1061 - protein, 101 aa, Artificial Sequence
  CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVT

SEQ ID NO: 1062 - protein, 101 aa, Artificial Sequence
  CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVT

SEQ ID NO: 1063 - protein, 101 aa, Artificial Sequence
  CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVT

SEQ ID NO: 1064 - protein, 101 aa, Artificial Sequence
  CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVT

SEQ ID NO: 1065 - protein, 101 aa, Artificial Sequence
  CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVT

SEQ ID NO: 1066 - protein, 101 aa, Artificial Sequence
  CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVT

SEQ ID NO: 1067 - protein, 101 aa, Artificial Sequence
  CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVT

SEQ ID NO: 1068 - protein, 101 aa, Artificial Sequence
  CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVT

SEQ ID NO: 1069 - protein, 101 aa, Artificial Sequence
  CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVT

SEQ ID NO: 1070 - protein, 101 aa, Artificial Sequence
  CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVT

SEQ ID NO: 1071 - protein, 101 aa, Artificial Sequence
  CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVT

SEQ ID NO: 1072 - protein, 101 aa, Artificial Sequence
  CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVT

SEQ ID NO: 1073 - protein, 101 aa, Artificial Sequence
  CD80 v156 IgV
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVT

SEQ ID NO: 1074 - protein, 101 aa, Artificial Sequence
  CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVT

SEQ ID NO: 1075 - protein, 101 aa, Artificial Sequence
  CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVT

SEQ ID NO: 1076 - protein, 101 aa, Artificial Sequence
  CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVT

SEQ ID NO: 1077 - protein, 101 aa, Artificial Sequence
  CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVT

SEQ ID NO: 1078 - protein, 101 aa, Artificial Sequence
  CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVT

SEQ ID NO: 1079 - protein, 101 aa, Artificial Sequence
  CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVT

SEQ ID NO: 1080 - protein, 101 aa, Artificial Sequence
  CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVT

SEQ ID NO: 1081 - protein, 101 aa, Artificial Sequence
  CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVT

SEQ ID NO: 1082 - protein, 101 aa, Artificial Sequence
  CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVT

SEQ ID NO: 1083 - protein, 101 aa, Artificial Sequence; identical to SEQ ID NO: 1065
  CD80 v166 IgV

SEQ ID NO: 1084 - protein, 101 aa, Artificial Sequence
  CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVT

SEQ ID NO: 1085 - protein, 101 aa, Artificial Sequence
  CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVT

SEQ ID NO: 1086 - protein, 101 aa, Artificial Sequence
  CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVT

SEQ ID NO: 1087 - protein, 101 aa, Artificial Sequence
  CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVT

SEQ ID NO: 1088 - protein, 101 aa, Artificial Sequence
  CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVT

SEQ ID NO: 1089 - protein, 101 aa, Artificial Sequence
  CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVT

SEQ ID NO: 1090 - protein, 101 aa, Artificial Sequence
  CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVT

SEQ ID NO: 1091 - protein, 101 aa, Artificial Sequence
  CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVT

SEQ ID NO: 1092 - protein, 101 aa, Artificial Sequence
  CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVT

SEQ ID NO: 1093 - protein, 101 aa, Artificial Sequence
  CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVT

SEQ ID NO: 1094 - protein, 101 aa, Artificial Sequence
  CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVT

SEQ ID NO: 1095 - protein, 101 aa, Artificial Sequence
  CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVT

SEQ ID NO: 1096 - protein, 101 aa, Artificial Sequence
  CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVT

SEQ ID NO: 1097 - protein, 101 aa, Artificial Sequence
  CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVT

SEQ ID NO: 1098 - protein, 101 aa, Artificial Sequence
  CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVT

SEQ ID NO: 1099 - protein, 101 aa, Artificial Sequence
  CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVT

SEQ ID NO: 1100 - protein, 101 aa, Artificial Sequence
  CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVT

SEQ ID NO: 1101 - protein, 101 aa, Artificial Sequence
  CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVT

SEQ ID NO: 1102 - protein, 101 aa, Artificial Sequence
  CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVT

SEQ ID NO: 1103 - protein, 101 aa, Artificial Sequence
  CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVT

SEQ ID NO: 1104 - protein, 101 aa, Artificial Sequence
  CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVT

SEQ ID NO: 1105 - protein, 101 aa, Artificial Sequence
  CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVT

SEQ ID NO: 1106 - protein, 101 aa, Artificial Sequence
  CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVT

SEQ ID NO: 1107 - protein, 101 aa, Artificial Sequence
  CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVT

SEQ ID NO: 1108 - protein, 101 aa, Artificial Sequence
  CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVT

SEQ ID NO: 1109 - protein, 101 aa, Artificial Sequence
  CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 1110 - protein, 101 aa, Artificial Sequence
  CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVT

SEQ ID NO: 1111 - protein, 101 aa, Artificial Sequence
  CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVT

SEQ ID NO: 1112 - protein, 101 aa, Artificial Sequence
  CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVT

SEQ ID NO: 1113 - protein, 107 aa, Artificial Sequence
  CD80 WT IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKAD

SEQ ID NO: 1114 - protein, 107 aa, Artificial Sequence
  CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKAD

SEQ ID NO: 1115 - protein, 107 aa, Artificial Sequence
  CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKAD

SEQ ID NO: 1116 - protein, 107 aa, Artificial Sequence
  CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKAD

SEQ ID NO: 1117 - protein, 107 aa, Artificial Sequence
  CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKAD

SEQ ID NO: 1118 - protein, 107 aa, Artificial Sequence
  CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 1119 - protein, 107 aa, Artificial Sequence
  CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKAD

SEQ ID NO: 1120 - protein, 107 aa, Artificial Sequence
  CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKAD

SEQ ID NO: 1121 - protein, 107 aa, Artificial Sequence
  CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKAD

SEQ ID NO: 1122 - protein, 107 aa, Artificial Sequence
  CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKAD

SEQ ID NO: 1123 - protein, 107 aa, Artificial Sequence
  CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKAD

SEQ ID NO: 1124 - protein, 107 aa, Artificial Sequence
  CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKAD

SEQ ID NO: 1125 - protein, 107 aa, Artificial Sequence
  CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKAD

SEQ ID NO: 1126 - protein, 107 aa, Artificial Sequence
  CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKAD

SEQ ID NO: 1127 - protein, 107 aa, Artificial Sequence
  CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKAD

SEQ ID NO: 1128 - protein, 107 aa, Artificial Sequence
  CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKAD

SEQ ID NO: 1129 - protein, 107 aa, Artificial Sequence
  CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKAD

SEQ ID NO: 1130 - protein, 107 aa, Artificial Sequence
  CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKAD

SEQ ID NO: 1131 - protein, 107 aa, Artificial Sequence
  CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKAD

SEQ ID NO: 1132 - protein, 107 aa, Artificial Sequence
  CD80 v141 IgV
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVTLSVKAD

SEQ ID NO: 1133 - protein, 107 aa, Artificial Sequence
  CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 1134 - protein, 107 aa, Artificial Sequence
  CD80 v143 IgV
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVTLSVKAD

SEQ ID NO: 1135 - protein, 107 aa, Artificial Sequence
  CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKAD

SEQ ID NO: 1136 - protein, 107 aa, Artificial Sequence
  CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKAD

SEQ ID NO: 1137 - protein, 107 aa, Artificial Sequence
  CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKAD

SEQ ID NO: 1138 - protein, 107 aa, Artificial Sequence
  CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKAD

SEQ ID NO: 1139 - protein, 107 aa, Artificial Sequence
  CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKAD

SEQ ID NO: 1140 - protein, 107 aa, Artificial Sequence
  CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKAD

SEQ ID NO: 1141 - protein, 107 aa, Artificial Sequence
  CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKAD

SEQ ID NO: 1142 - protein, 107 aa, Artificial Sequence
  CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKAD

SEQ ID NO: 1143 - protein, 107 aa, Artificial Sequence
  CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKAD

SEQ ID NO: 1144 - protein, 107 aa, Artificial Sequence
  CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKAD

SEQ ID NO: 1145 - protein, 107 aa, Artificial Sequence
  CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKAD

SEQ ID NO: 1146 - protein, 107 aa, Artificial Sequence
  CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKAD

SEQ ID NO: 1147 - protein, 107 aa, Artificial Sequence
  CD80 v156 IgV
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKAD

SEQ ID NO: 1148 - protein, 107 aa, Artificial Sequence
  CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKAD

SEQ ID NO: 1149 - protein, 107 aa, Artificial Sequence
  CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKAD

SEQ ID NO: 1150 - protein, 107 aa, Artificial Sequence
  CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKAD

SEQ ID NO: 1151 - protein, 107 aa, Artificial Sequence
  CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKAD

SEQ ID NO: 1152 - protein, 107 aa, Artificial Sequence
  CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKAD

SEQ ID NO: 1153 - protein, 107 aa, Artificial Sequence
  CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKAD

SEQ ID NO: 1154 - protein, 107 aa, Artificial Sequence
  CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKAD

SEQ ID NO: 1155 - protein, 107 aa, Artificial Sequence
  CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKAD

SEQ ID NO: 1156 - protein, 107 aa, Artificial Sequence
  CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKAD

SEQ ID NO: 1157 - protein, 107 aa, Artificial Sequence; identical to SEQ ID NO: 1139
  CD80 v166 IgV

SEQ ID NO: 1158 - protein, 107 aa, Artificial Sequence
  CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKAD

SEQ ID NO: 1159 - protein, 107 aa, Artificial Sequence
  CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKAD

SEQ ID NO: 1160 - protein, 107 aa, Artificial Sequence
  CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKAD

SEQ ID NO: 1161 - protein, 107 aa, Artificial Sequence
  CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKAD

SEQ ID NO: 1162 - protein, 107 aa, Artificial Sequence
  CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKAD

SEQ ID NO: 1163 - protein, 107 aa, Artificial Sequence
  CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKAD

SEQ ID NO: 1164 - protein, 107 aa, Artificial Sequence
  CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKAD

SEQ ID NO: 1165 - protein, 107 aa, Artificial Sequence
  CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKAD

SEQ ID NO: 1166 - protein, 107 aa, Artificial Sequence
  CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKAD

SEQ ID NO: 1167 - protein, 107 aa, Artificial Sequence
  CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKAD

SEQ ID NO: 1168 - protein, 107 aa, Artificial Sequence
  CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKAD

SEQ ID NO: 1169 - protein, 107 aa, Artificial Sequence
  CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKAD

SEQ ID NO: 1170 - protein, 107 aa, Artificial Sequence
  CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKAD

SEQ ID NO: 1171 - protein, 107 aa, Artificial Sequence
  CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKAD

SEQ ID NO: 1172 - protein, 107 aa, Artificial Sequence
  CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKAD

SEQ ID NO: 1173 - protein, 107 aa, Artificial Sequence
  CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKAD

SEQ ID NO: 1174 - protein, 107 aa, Artificial Sequence
  CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKAD

SEQ ID NO: 1175 - protein, 107 aa, Artificial Sequence
  CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKAD

SEQ ID NO: 1176 - protein, 107 aa, Artificial Sequence
  CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKAD

SEQ ID NO: 1177 - protein, 107 aa, Artificial Sequence
  CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKAD

SEQ ID NO: 1178 - protein, 107 aa, Artificial Sequence
  CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 1179 - protein, 107 aa, Artificial Sequence
  CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKAD

SEQ ID NO: 1180 - protein, 107 aa, Artificial Sequence
  CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKAD

SEQ ID NO: 1181 - protein, 107 aa, Artificial Sequence
  CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKAD

SEQ ID NO: 1182 - protein, 107 aa, Artificial Sequence
  CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKAD

SEQ ID NO: 1183 - protein, 107 aa, Artificial Sequence
  CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 1184 - protein, 107 aa, Artificial Sequence
  CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKAD

SEQ ID NO: 1185 - protein, 107 aa, Artificial Sequence
  CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKAD

SEQ ID NO: 1186 - protein, 107 aa, Artificial Sequence
  CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKAD

SEQ ID NO: 1187 - protein, 232 aa, Artificial Sequence
  Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1188 - protein, 232 aa, Artificial Sequence
  Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1189 - protein, 232 aa, Artificial Sequence
  Stack Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1190 - protein, 8 aa, Artificial Sequence
  Stuffer
HMSSVSAQ

SEQ ID NO: 1191 - protein, 481 aa, Artificial Sequence
  PD-L2/CD155 Stack 1 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1192 - protein, 481 aa, Artificial Sequence
  PD-L2/CD155 Stack 2 Fc fusion
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1193 - protein, 481 aa, Artificial Sequence
  PD-L2/CD155 Stack 3 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1194 - protein, 481 aa, Artificial Sequence
  PD-L2/CD155 Stack 4 Fc fusion
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1195 - protein, 486 aa, Artificial Sequence
  PD-L2/CD155 Stack 5 Fc fusion
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1196 - protein, 486 aa, Artificial Sequence
  PD-L2/CD155 Stack 6 Fc fusion
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1197 - protein, 481 aa, Artificial Sequence
  PD-L2/CD155 Stack 7
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1198 - protein, 481 aa, Artificial Sequence
  PD-L2/CD155 Stack 8
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1199 - protein, 735 aa, Artificial Sequence
  PD-L2/CD155 Stack 9
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1200 - protein, 735 aa, Artificial Sequence
  PD-L2/CD155 Stack 10
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1201 - protein, 501 aa, Artificial Sequence
  PD-L2/CD155 Stack 11 Knob Fc
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1202 - protein, 461 aa, Artificial Sequence
  PD-L2/CD155 Stack 11 Hole Fc
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1203 - protein, 514 aa, Artificial Sequence
  PD-L2/CD155 Stack 12 Knob Fc
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1204 - protein, 474 aa, Artificial Sequence
  PD-L2/CD155 Stack 12 Hole Fc
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1205 - protein, 232 aa, Artificial Sequence
  Fc (C5S (C220S), R77C, (R292C),  N82G (N297G), V87C (V302C))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1206 - protein, 232 aa, Artificial Sequence
  Fc with C220S/L234A/L235E/G237A
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1207 - protein, 231 aa, Artificial Sequence
  Fc with C220S/E233P/L234V/L235A/G236del/S267K
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1208 - protein, 431 aa, Artificial Sequence
  antiCD19z chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1209 - protein, 21 aa, Artificial Sequence
  CD8-derived signal sequence
MALPVTALLLPLALLLHAARP

SEQ ID NO: 1210 - protein, 23 aa, Artificial Sequence
  CD8-derived signal sequence
MALPVTALLLPLALLLHAARPGS

SEQ ID NO: 1211 - protein, 245 aa, Artificial Sequence
  anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1212 - protein, 69 aa, Artificial Sequence
  CD8-derived hinge and transmembrane domain
AKPTTTPAPRPPTPAPTIASQPLSLRPEACRPAAGGAVHTRGLDFACDIYIWAPLAGTCGVLLLSLVIT

SEQ ID NO: 1213 - protein, 42 aa, Artificial Sequence
  4-1BB-derived costimulatory domain
KRGRKKLLYIFKQPFMRPVQTTQEEDGCSCRFPEEEEGGCEL

SEQ ID NO: 1214 - protein, 40 aa, Artificial Sequence
  CD28-derived costimulatory domain
SKRSRLLHSDYMNMTPRRPGPTRKHYQPYAPPRDFAAYRS

SEQ ID NO: 1215 - protein, 41 aa, Artificial Sequence
  CD28-derived costimulatory domain
RSKRSRLLHSDYMNMTPRRPGPTRKHYQPYAPPRDFAAYRS

SEQ ID NO: 1216 - protein, 44 aa, Artificial Sequence
  CD28-derived costimulatory domain
FWVRSKRSRLLHSDYMNMTPRRPGPTRKHYQPYAPPRDFAAYRS

SEQ ID NO: 1217 - protein, 20 aa, Artificial Sequence
  T2A protein
SGEGRGSLLTCGDVEENPGP

SEQ ID NO: 1218 - protein, 232 aa, Artificial Sequence
  Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 1219 - protein, 472 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1220 - protein, 497 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSR

SEQ ID NO: 1221 - protein, 471 aa, Artificial Sequence
  2nd Gen CAR with CD28-derived costimulatory domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1222 - protein, 248 aa, Artificial Sequence
  Anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAA

SEQ ID NO: 1223 - DNA, 1356 bp, Artificial Sequence
  AntiCD19 chimeric antigen receptor nucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagcggccgcaaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1224 - DNA, 63 bp, Artificial Sequence
  T2A Nucleotide
ggcagtggcgagggcagaggaagtctgctaacatgcggtgacgtcgaggagaatcctggccca

SEQ ID NO: 1225 - protein, 21 aa, Artificial Sequence
  T2A Protein
GSGEGRGSLLTCGDVEENPGP

SEQ ID NO: 1226 - protein, 117 aa, Artificial Sequence
  NKp30 v1 ECD
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLG

SEQ ID NO: 1227 - protein, 117 aa, Artificial Sequence
  NKp30 v2 ECD
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 1228 - protein, 117 aa, Artificial Sequence
  NKp30 v3 ECD
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLVVEKEHPQLG

SEQ ID NO: 1229 - protein, 117 aa, Artificial Sequence
  NKp30 v4 ECD
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLVVEKEHPQLG

SEQ ID NO: 1230 - protein, 117 aa, Artificial Sequence
  NKp30 v5 ECD
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLVVEKEHPQLG

SEQ ID NO: 1231 - protein, 108 aa, Artificial Sequence
  NKp30 WT IgC-like
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLV

SEQ ID NO: 1232 - protein, 108 aa, Artificial Sequence
  NKp30 v1 IgC-like
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLV

SEQ ID NO: 1233 - protein, 108 aa, Artificial Sequence
  NKp30 v2 IgC-like
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLV

SEQ ID NO: 1234 - protein, 108 aa, Artificial Sequence
  NKp30 v3 IgC-like
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLV

SEQ ID NO: 1235 - protein, 108 aa, Artificial Sequence
  NKp30 v4 IgC-like
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLV

SEQ ID NO: 1236 - protein, 108 aa, Artificial Sequence
  NKp30 v5 IgC-like
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLV

SEQ ID NO: 1237 - protein, 270 aa, Artificial Sequence
  Nkp30 stack
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGGSGGGGSAAAEPK

SEQ ID NO: 1238 - protein, 116 aa, Artificial Sequence
  NKp30 v1 IgC-like (long)
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQL

SEQ ID NO: 1239 - protein, 224 aa, Artificial Sequence
  CD86 v1 ECD
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1240 - protein, 224 aa, Artificial Sequence
  CD86 v2 ECD
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1241 - protein, 224 aa, Artificial Sequence
  CD86 v3 ECD
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1242 - protein, 224 aa, Artificial Sequence
  CD86 v4 ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1243 - protein, 108 aa, Artificial Sequence
  CD86 WT IgV
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELS

SEQ ID NO: 1244 - protein, 108 aa, Artificial Sequence
  CD86 v1 IgV
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELS

SEQ ID NO: 1245 - protein, 108 aa, Artificial Sequence
  CD86 v2 IgV
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELS

SEQ ID NO: 1246 - protein, 108 aa, Artificial Sequence
  CD86 v3 IgV
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELS

SEQ ID NO: 1247 - protein, 108 aa, Artificial Sequence
  CD86 v4 IgV
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELS

SEQ ID NO: 1248 - protein, 229 aa, Artificial Sequence
  IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1249 - protein, 229 aa, Artificial Sequence
  IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1250 - protein, 232 aa, Artificial Sequence
  IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1251 - protein, 19 aa, Artificial Sequence
  PD-L2 Signal Peptide
MIFLLLMLSLELQLHQIAA

SEQ ID NO: 1252 - protein, 15 aa, Artificial Sequence
  Avitag
GLNDIFEAQKIEWHE

SEQ ID NO: 1253 - protein, 6 aa, artificial Sequence
  His tag
HHHHHH

SEQ ID NO: 1254 - protein, 121 aa, Artificial Sequence
  WT PD-L2 SIP
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 1255 - protein, 121 aa, artificial Sequence
  PD-L2 v49 SIP
MIFLLLMLSLELQLHQIAALFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKA

SEQ ID NO: 1256 - protein, 121 aa, Artificial Sequence
  PD-L2 v62 SIP
MIFLLLMLSLELQLHQIAALFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1257 - protein, 121 aa, Artificial Sequence
  PD-L2 v76 SIP
MIFLLLMLSLELQLHQIAALFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKA

SEQ ID NO: 1258 - protein, 107 aa, Artificial Sequence
  PD-L1 IgV
PKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKV

SEQ ID NO: 1259 - protein, 220 aa, Artificial Sequence
  PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1260 - protein, 220 aa, Artificial Sequence
  PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1261 - protein, 220 aa, Artificial Sequence
  PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1262 - protein, 220 aa, Artificial Sequence
  PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1263 - protein, 220 aa, Artificial Sequence
  PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1264 - protein, 220 aa, Artificial Sequence
  PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1265 - protein, 220 aa, Artificial Sequence
  PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1266 - protein, 220 aa, Artificial Sequence
  PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1267 - protein, 220 aa, Artificial Sequence
  PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1268 - protein, 220 aa, Artificial Sequence
  PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1269 - protein, 220 aa, Artificial Sequence
  PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1270 - protein, 220 aa, Artificial Sequence
  PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1271 - protein, 220 aa, Artificial Sequence
  PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1272 - protein, 220 aa, Artificial Sequence
  PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1273 - protein, 220 aa, Artificial Sequence
  PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1274 - protein, 220 aa, Artificial Sequence
  PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1275 - protein, 220 aa, Artificial Sequence
  PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1276 - protein, 220 aa, Artificial Sequence
  PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1277 - protein, 220 aa, Artificial Sequence
  PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1278 - protein, 220 aa, Artificial Sequence
  PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1279 - protein, 220 aa, Artificial Sequence
  PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1280 - protein, 220 aa, Artificial Sequence
  PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1281 - protein, 220 aa, Artificial Sequence
  PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1282 - protein, 220 aa, Artificial Sequence
  PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1283 - protein, 220 aa, Artificial Sequence
  PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1284 - protein, 220 aa, Artificial Sequence
  PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1285 - protein, 220 aa, Artificial Sequence
  PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1286 - protein, 220 aa, Artificial Sequence
  PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1287 - protein, 220 aa, Artificial Sequence
  PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1288 - protein, 220 aa, Artificial Sequence
  PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1289 - protein, 220 aa, Artificial Sequence
  PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1290 - protein, 220 aa, Artificial Sequence
  PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1291 - protein, 220 aa, Artificial Sequence
  PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1292 - protein, 220 aa, Artificial Sequence
  PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1293 - protein, 220 aa, Artificial Sequence
  PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1294 - protein, 220 aa, Artificial Sequence
  PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1295 - protein, 220 aa, Artificial Sequence
  PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1296 - protein, 220 aa, Artificial Sequence
  PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1297 - protein, 220 aa, Artificial Sequence
  PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1298 - protein, 220 aa, Artificial Sequence
  PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1299 - protein, 220 aa, Artificial Sequence
  PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1300 - protein, 220 aa, Artificial Sequence
  PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1301 - protein, 220 aa, Artificial Sequence
  PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1302 - protein, 220 aa, Artificial Sequence
  PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1303 - protein, 220 aa, Artificial Sequence
  PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1304 - protein, 220 aa, Artificial Sequence
  PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1305 - protein, 220 aa, Artificial Sequence
  PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1306 - protein, 220 aa, Artificial Sequence
  PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1307 - protein, 220 aa, Artificial Sequence
  PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1308 - protein, 220 aa, Artificial Sequence
  PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1309 - protein, 220 aa, Artificial Sequence
  PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1310 - protein, 220 aa, Artificial Sequence
  PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1311 - protein, 220 aa, Artificial Sequence
  PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1312 - protein, 220 aa, Artificial Sequence
  PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1313 - protein, 220 aa, Artificial Sequence; identical to SEQ ID NO: 1269
  PD-L1 ECD v55

SEQ ID NO: 1314 - protein, 220 aa, Artificial Sequence
  PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1315 - protein, 220 aa, Artificial Sequence
  PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1316 - protein, 220 aa, Artificial Sequence
  PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1317 - protein, 220 aa, Artificial Sequence
  PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1318 - protein, 221 aa, Artificial Sequence
  PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1319 - protein, 220 aa, Artificial Sequence
  PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1320 - protein, 220 aa, Artificial Sequence
  PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1321 - protein, 220 aa, Artificial Sequence
  PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1322 - protein, 220 aa, Artificial Sequence
  PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1323 - protein, 220 aa, Artificial Sequence
  PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1324 - protein, 107 aa, Artificial Sequence
  PD-L1 IgV v1
PKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKV

SEQ ID NO: 1325 - protein, 107 aa, Artificial Sequence
  PD-L1 IgV v2
PKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKV

SEQ ID NO: 1326 - protein, 107 aa, Artificial Sequence
  PD-L1 IgV v3
PKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKV

SEQ ID NO: 1327 - protein, 107 aa, Artificial Sequence
  PD-L1 IgV v4
SKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKV

SEQ ID NO: 1328 - protein, 107 aa, Artificial Sequence
  PD-L1 IgV v5
PKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKV

SEQ ID NO: 1329 - protein, 107 aa, Artificial Sequence
  PD-L1 IgV v6
PKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKV

SEQ ID NO: 1330 - protein, 107 aa, Artificial Sequence
  PD-L1 IgV v7
PKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 1331 - protein, 107 aa, Artificial Sequence
  PD-L1 IgV v8
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 1332 - protein, 107 aa, Artificial Sequence
  PD-L1 IgV v9
PKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 1333 - protein, 107 aa, Artificial Sequence
  PD-L1 IgV v10
PKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKV

SEQ ID NO: 1334 - protein, 107 aa, Artificial Sequence
  PD-L1 IgV v11
PKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKV

SEQ ID NO: 1335 - protein, 107 aa, Artificial Sequence
  PD-L1 IgV v12
PKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKV

SEQ ID NO: 1336 - protein, 107 aa, Artificial Sequence
  PD-L1 IgV v13
PKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKV

SEQ ID NO: 1337 - protein, 107 aa, Artificial Sequence
  PD-L1 IgV v14
PKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1338 - protein, 107 aa, Artificial Sequence
  PD-L1 IgV v15
PKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 1339 - protein, 107 aa, Artificial Sequence
  PD-L1 IgV v16
PKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1340 - protein, 107 aa, Artificial Sequence
  PD-L1 IgV v17
PKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKV

SEQ ID NO: 1341 - protein, 107 aa, Artificial Sequence
  PD-L1 IgV v18
PKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKV

SEQ ID NO: 1342 - protein, 107 aa, Artificial Sequence
  PD-L1 IgV v19
PKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKV

SEQ ID NO: 1343 - protein, 107 aa, Artificial Sequence
  PD-L1 IgV v20
PKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKV

SEQ ID NO: 1344 - protein, 107 aa, Artificial Sequence
  PD-L1 IgV v21
PKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKV

SEQ ID NO: 1345 - protein, 107 aa, Artificial Sequence
  PD-L1 IgV v22
PKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKV

SEQ ID NO: 1346 - protein, 107 aa, Artificial Sequence
  PD-L1 IgV v23
PKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKV

SEQ ID NO: 1347 - protein, 107 aa, Artificial Sequence
  PD-L1 IgV v24
PKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKV

SEQ ID NO: 1348 - protein, 107 aa, Artificial Sequence
  PD-L1 IgV v25
PKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKV

SEQ ID NO: 1349 - protein, 107 aa, Artificial Sequence
  PD-L1 IgV v26
PKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKV

SEQ ID NO: 1350 - protein, 107 aa, Artificial Sequence
  PD-L1 IgV v27
PKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKV

SEQ ID NO: 1351 - protein, 107 aa, Artificial Sequence
  PD-L1 IgV v28
PKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKV

SEQ ID NO: 1352 - protein, 107 aa, Artificial Sequence
  PD-L1 IgV v29
PKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKV

SEQ ID NO: 1353 - protein, 107 aa, Artificial Sequence
  PD-L1 IgV v30
PKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKV

SEQ ID NO: 1354 - protein, 107 aa, Artificial Sequence
  PD-L1 IgV v31
PKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKV

SEQ ID NO: 1355 - protein, 107 aa, Artificial Sequence
  PD-L1 IgV v32
PKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKV

SEQ ID NO: 1356 - protein, 107 aa, Artificial Sequence
  PD-L1 IgV v33
PKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKV

SEQ ID NO: 1357 - protein, 107 aa, Artificial Sequence
  PD-L1 IgV v34
PKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1358 - protein, 107 aa, Artificial Sequence
  PD-L1 IgV v35
PKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKV

SEQ ID NO: 1359 - protein, 107 aa, Artificial Sequence
  PD-L1 IgV v36
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKV

SEQ ID NO: 1360 - protein, 107 aa, Artificial Sequence
  PD-L1 IgV v37
PKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKV

SEQ ID NO: 1361 - protein, 107 aa, Artificial Sequence
  PD-L1 IgV v38
PKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKV

SEQ ID NO: 1362 - protein, 107 aa, Artificial Sequence
  PD-L1 IgV v39
PKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKV

SEQ ID NO: 1363 - protein, 107 aa, Artificial Sequence
  PD-L1 IgV v40
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKV

SEQ ID NO: 1364 - protein, 107 aa, Artificial Sequence
  PD-L1 IgV v41
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKV

SEQ ID NO: 1365 - protein, 107 aa, Artificial Sequence
  PD-L1 IgV v42
PKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKV

SEQ ID NO: 1366 - protein, 107 aa, Artificial Sequence
  PD-L1 IgV v43
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKV

SEQ ID NO: 1367 - protein, 107 aa, Artificial Sequence
  PD-L1 IgV v44
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKV

SEQ ID NO: 1368 - protein, 107 aa, Artificial Sequence
  PD-L1 IgV v45
PKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 1369 - protein, 107 aa, Artificial Sequence
  PD-L1 IgV v46
PKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKV

SEQ ID NO: 1370 - protein, 107 aa, Artificial Sequence
  PD-L1 IgV v47
PKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 1371 - protein, 107 aa, Artificial Sequence
  PD-L1 IgV v48
PKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKV

SEQ ID NO: 1372 - protein, 107 aa, Artificial Sequence
  PD-L1 IgV v49
PKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKV

SEQ ID NO: 1373 - protein, 107 aa, Artificial Sequence
  PD-L1 IgV v50
PKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKV

SEQ ID NO: 1374 - protein, 107 aa, Artificial Sequence
  PD-L1 IgV v51
PKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKV

SEQ ID NO: 1375 - protein, 107 aa, Artificial Sequence
  PD-L1 IgV v52
PKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKV

SEQ ID NO: 1376 - protein, 107 aa, Artificial Sequence
  PD-L1 IgV v53
PKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKV

SEQ ID NO: 1377 - protein, 107 aa, Artificial Sequence
  PD-L1 IgV v54
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKV

SEQ ID NO: 1378 - protein, 107 aa, Artificial Sequence; identical to SEQ ID NO: 1334
  PD-L1 IgV v55

SEQ ID NO: 1379 - protein, 107 aa, Artificial Sequence
  PD-L1 IgV v56
PKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKV

SEQ ID NO: 1380 - protein, 107 aa, Artificial Sequence
  PD-L1 IgV v57
PKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKV

SEQ ID NO: 1381 - protein, 107 aa, Artificial Sequence
  PD-L1 IgV v58
PKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKV

SEQ ID NO: 1382 - protein, 107 aa, Artificial Sequence
  PD-L1 IgV v59
PKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKV

SEQ ID NO: 1383 - protein, 108 aa, Artificial Sequence
  PD-L1 IgV v60
PKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKV

SEQ ID NO: 1384 - protein, 107 aa, Artificial Sequence
  PD-L1 IgV v61
PKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 1385 - protein, 107 aa, Artificial Sequence
  PD-L1 IgV v62
PKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKV

SEQ ID NO: 1386 - protein, 107 aa, Artificial Sequence
  PD-L1 IgV v63
PKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKV

SEQ ID NO: 1387 - protein, 107 aa, Artificial Sequence
  PD-L1 IgV v64
PKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKV

SEQ ID NO: 1388 - protein, 107 aa, Artificial Sequence
  PD-L1 IgV v65
PKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 1389 - protein, 114 aa, Artificial Sequence
  PD-L1 IgV v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNA

SEQ ID NO: 1390 - protein, 114 aa, Artificial Sequence
  PD-L1 IgV v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNA

SEQ ID NO: 1391 - protein, 114 aa, Artificial Sequence
  PD-L1 IgV v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNA

SEQ ID NO: 1392 - protein, 114 aa, Artificial Sequence
  PD-L1 IgV v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNA

SEQ ID NO: 1393 - protein, 114 aa, Artificial Sequence
  PD-L1 IgV v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNA

SEQ ID NO: 1394 - protein, 114 aa, Artificial Sequence
  PD-L1 IgV v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNA

SEQ ID NO: 1395 - protein, 114 aa, Artificial Sequence
  PD-L1 IgV v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 1396 - protein, 114 aa, Artificial Sequence
  PD-L1 IgV v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 1397 - protein, 114 aa, Artificial Sequence
  PD-L1 IgV v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 1398 - protein, 114 aa, Artificial Sequence
  PD-L1 IgV v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNA

SEQ ID NO: 1399 - protein, 114 aa, Artificial Sequence
  PD-L1 IgV v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNA

SEQ ID NO: 1400 - protein, 114 aa, Artificial Sequence
  PD-L1 IgV v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNA

SEQ ID NO: 1401 - protein, 114 aa, Artificial Sequence
  PD-L1 IgV v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNA

SEQ ID NO: 1402 - protein, 114 aa, Artificial Sequence
  PD-L1 IgV v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1403 - protein, 114 aa, Artificial Sequence
  PD-L1 IgV v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 1404 - protein, 114 aa, Artificial Sequence
  PD-L1 IgV v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1405 - protein, 114 aa, Artificial Sequence
  PD-L1 IgV v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNA

SEQ ID NO: 1406 - protein, 114 aa, Artificial Sequence
  PD-L1 IgV v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNA

SEQ ID NO: 1407 - protein, 114 aa, Artificial Sequence
  PD-L1 IgV v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNA

SEQ ID NO: 1408 - protein, 114 aa, Artificial Sequence
  PD-L1 IgV v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNA

SEQ ID NO: 1409 - protein, 114 aa, Artificial Sequence
  PD-L1 IgV v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNA

SEQ ID NO: 1410 - protein, 114 aa, Artificial Sequence
  PD-L1 IgV v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNA

SEQ ID NO: 1411 - protein, 114 aa, Artificial Sequence
  PD-L1 IgV v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNA

SEQ ID NO: 1412 - protein, 114 aa, Artificial Sequence
  PD-L1 IgV v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNA

SEQ ID NO: 1413 - protein, 114 aa, Artificial Sequence
  PD-L1 IgV v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNA

SEQ ID NO: 1414 - protein, 114 aa, Artificial Sequence
  PD-L1 IgV v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNA

SEQ ID NO: 1415 - protein, 114 aa, Artificial Sequence
  PD-L1 IgV v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNA

SEQ ID NO: 1416 - protein, 114 aa, Artificial Sequence
  PD-L1 IgV v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNA

SEQ ID NO: 1417 - protein, 114 aa, Artificial Sequence
  PD-L1 IgV v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 1418 - protein, 114 aa, Artificial Sequence
  PD-L1 IgV v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNA

SEQ ID NO: 1419 - protein, 114 aa, Artificial Sequence
  PD-L1 IgV v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNA

SEQ ID NO: 1420 - protein, 114 aa, Artificial Sequence
  PD-L1 IgV v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNA

SEQ ID NO: 1421 - protein, 114 aa, Artificial Sequence
  PD-L1 IgV v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNA

SEQ ID NO: 1422 - protein, 114 aa, Artificial Sequence
  PD-L1 IgV v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1423 - protein, 114 aa, Artificial Sequence
  PD-L1 IgV v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNA

SEQ ID NO: 1424 - protein, 114 aa, Artificial Sequence
  PD-L1 IgV v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNA

SEQ ID NO: 1425 - protein, 114 aa, Artificial Sequence
  PD-L1 IgV v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNA

SEQ ID NO: 1426 - protein, 114 aa, Artificial Sequence
  PD-L1 IgV v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNA

SEQ ID NO: 1427 - protein, 114 aa, Artificial Sequence
  PD-L1 IgV v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNA

SEQ ID NO: 1428 - protein, 114 aa, Artificial Sequence
  PD-L1 IgV v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNA

SEQ ID NO: 1429 - protein, 114 aa, Artificial Sequence
  PD-L1 IgV v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNA

SEQ ID NO: 1430 - protein, 114 aa, Artificial Sequence
  PD-L1 IgV v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNA

SEQ ID NO: 1431 - protein, 114 aa, Artificial Sequence
  PD-L1 IgV v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNA

SEQ ID NO: 1432 - protein, 114 aa, Artificial Sequence
  PD-L1 IgV v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNA

SEQ ID NO: 1433 - protein, 114 aa, Artificial Sequence
  PD-L1 IgV v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 1434 - protein, 114 aa, Artificial Sequence
  PD-L1 IgV v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 1435 - protein, 114 aa, Artificial Sequence
  PD-L1 IgV v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 1436 - protein, 114 aa, Artificial Sequence
  PD-L1 IgV v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNA

SEQ ID NO: 1437 - protein, 114 aa, Artificial Sequence
  PD-L1 IgV v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNA

SEQ ID NO: 1438 - protein, 114 aa, Artificial Sequence
  PD-L1 IgV v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 1439 - protein, 114 aa, Artificial Sequence
  PD-L1 IgV v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 1440 - protein, 114 aa, Artificial Sequence
  PD-L1 IgV v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNA

SEQ ID NO: 1441 - protein, 114 aa, Artificial Sequence
  PD-L1 IgV v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNA

SEQ ID NO: 1442 - protein, 114 aa, Artificial Sequence
  PD-L1 IgV v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNA

SEQ ID NO: 1443 - protein, 114 aa, Artificial Sequence; identical to SEQ ID NO: 1399
  PD-L1 IgV v55

SEQ ID NO: 1444 - protein, 114 aa, Artificial Sequence
  PD-L1 IgV v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNA

SEQ ID NO: 1445 - protein, 114 aa, Artificial Sequence
  PD-L1 IgV v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNA

SEQ ID NO: 1446 - protein, 114 aa, Artificial Sequence
  PD-L1 IgV v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNA

SEQ ID NO: 1447 - protein, 114 aa, Artificial Sequence
  PD-L1 IgV v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNA

SEQ ID NO: 1448 - protein, 115 aa, Artificial Sequence
  PD-L1 IgV v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 1449 - protein, 114 aa, Artificial Sequence
  PD-L1 IgV v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 1450 - protein, 114 aa, Artificial Sequence
  PD-L1 IgV v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNA

SEQ ID NO: 1451 - protein, 114 aa, Artificial Sequence
  PD-L1 IgV v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNA

SEQ ID NO: 1452 - protein, 114 aa, Artificial Sequence
  PD-L1 IgV v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNA

SEQ ID NO: 1453 - protein, 114 aa, Artificial Sequence
  PD-L1 IgV v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 1454 - protein, 114 aa, Homo sapiens
  MISC_FEATURE: PD-L1 IgV wildtype
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNA

SEQ ID NO: 1455 - protein, 329 aa, Artificial sequence
  CD112 v89 ECD
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1456 - protein, 329 aa, Artificial sequence
  CD112 v90 ECD
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1457 - protein, 329 aa, Artificial sequence
  CD112 v91 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1458 - protein, 329 aa, Artificial sequence
  CD112 v92 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1459 - protein, 329 aa, Artificial sequence
  CD112 v93 ECD
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1460 - protein, 329 aa, Artificial sequence
  CD112 v94 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1461 - protein, 329 aa, Artificial sequence
  CD112 v95 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1462 - protein, 329 aa, Artificial sequence
  CD112 v96 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1463 - protein, 329 aa, Artificial sequence
  CD112 v97 ECD
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1464 - protein, 329 aa, Artificial sequence
  CD112 v98 ECD
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1465 - protein, 329 aa, Artificial sequence
  CD112 v99 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1466 - protein, 329 aa, Artificial sequence
  CD112 v100 ECD
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1467 - protein, 329 aa, Artificial sequence
  CD112 v101 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1468 - protein, 329 aa, Artificial sequence
  CD112 v102 ECD
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1469 - protein, 329 aa, Artificial sequence
  CD112 v103 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1470 - protein, 329 aa, Artificial sequence
  CD112 v104 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1471 - protein, 329 aa, Artificial sequence
  CD112 v105 ECD
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1472 - protein, 329 aa, Artificial sequence
  CD112 v106 ECD
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1473 - protein, 329 aa, Artificial sequence
  CD112 v107 ECD
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1474 - protein, 329 aa, Artificial sequence
  CD112 v108 ECD
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1475 - protein, 329 aa, Artificial sequence
  CD112 v109 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1476 - protein, 329 aa, Artificial sequence
  CD112 v100 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1477 - protein, 329 aa, Artificial sequence
  CD112 v111 ECD
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1478 - protein, 329 aa, Artificial sequence
  CD112 v112 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1479 - protein, 125 aa, Artificial sequence
  CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWL

SEQ ID NO: 1480 - protein, 125 aa, Artificial sequence
  CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 1481 - protein, 125 aa, Artificial sequence
  CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 1482 - protein, 125 aa, Artificial sequence
  CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 1483 - protein, 125 aa, Artificial sequence
  CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWL

SEQ ID NO: 1484 - protein, 125 aa, Artificial sequence
  CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 1485 - protein, 125 aa, Artificial sequence
  CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWL

SEQ ID NO: 1486 - protein, 125 aa, Artificial sequence
  CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWL

SEQ ID NO: 1487 - protein, 125 aa, Artificial sequence
  CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWL

SEQ ID NO: 1488 - protein, 125 aa, Artificial sequence
  CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWA

SEQ ID NO: 1489 - protein, 125 aa, Artificial sequence
  CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWL

SEQ ID NO: 1490 - protein, 125 aa, Artificial sequence
  CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 1491 - protein, 125 aa, Artificial sequence
  CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWL

SEQ ID NO: 1492 - protein, 125 aa, Artificial sequence
  CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWL

SEQ ID NO: 1493 - protein, 125 aa, Artificial sequence
  CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWL

SEQ ID NO: 1494 - protein, 125 aa, Artificial sequence
  CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWL

SEQ ID NO: 1495 - protein, 125 aa, Artificial sequence
  CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWL

SEQ ID NO: 1496 - protein, 125 aa, Artificial sequence
  CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWL

SEQ ID NO: 1497 - protein, 125 aa, Artificial sequence
  CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWL

SEQ ID NO: 1498 - protein, 125 aa, Artificial sequence
  CD112 v108 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWL

SEQ ID NO: 1499 - protein, 125 aa, Artificial sequence
  CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWL

SEQ ID NO: 1500 - protein, 125 aa, Artificial sequence
  CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWL

SEQ ID NO: 1501 - protein, 125 aa, Artificial sequence
  CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLL

SEQ ID NO: 1502 - protein, 125 aa, Artificial sequence
  CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 1503 - protein, 127 aa, Artificial sequence
  CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRV

SEQ ID NO: 1504 - protein, 127 aa, Artificial sequence
  CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 1505 - protein, 127 aa, Artificial sequence
  CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 1506 - protein, 127 aa, Artificial sequence
  CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 1507 - protein, 127 aa, Artificial sequence
  CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRV

SEQ ID NO: 1508 - protein, 127 aa, Artificial sequence
  CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 1509 - protein, 127 aa, Artificial sequence
  CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRV

SEQ ID NO: 1510 - protein, 127 aa, Artificial sequence
  CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRV

SEQ ID NO: 1511 - protein, 127 aa, Artificial sequence
  CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRV

SEQ ID NO: 1512 - protein, 127 aa, Artificial sequence
  CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARV

SEQ ID NO: 1513 - protein, 127 aa, Artificial sequence
  CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRV

SEQ ID NO: 1514 - protein, 127 aa, Artificial sequence
  CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1515 - protein, 127 aa, Artificial sequence
  CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRV

SEQ ID NO: 1516 - protein, 127 aa, Artificial sequence
  CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRV

SEQ ID NO: 1517 - protein, 127 aa, Artificial sequence
  CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRV

SEQ ID NO: 1518 - protein, 127 aa, Artificial sequence
  CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRV

SEQ ID NO: 1519 - protein, 127 aa, Artificial sequence
  CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRV

SEQ ID NO: 1520 - protein, 127 aa, Artificial sequence
  CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRV

SEQ ID NO: 1521 - protein, 127 aa, Artificial sequence
  CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRV

SEQ ID NO: 1522 - protein, 127 aa, Artificial sequence
  CD112 v109 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRV

SEQ ID NO: 1523 - protein, 127 aa, Artificial sequence
  CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRV

SEQ ID NO: 1524 - protein, 127 aa, Artificial sequence
  CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRV

SEQ ID NO: 1525 - protein, 127 aa, Artificial sequence
  CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRV

SEQ ID NO: 1526 - protein, 127 aa, Artificial sequence
  CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 1527 - protein, 116 aa, Artificial Sequence
  CD155 v120 IgV
PGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWL

SEQ ID NO: 1528 - protein, 116 aa, Artificial Sequence
  CD155 v121 IgV
PGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWL

SEQ ID NO: 1529 - protein, 116 aa, Artificial Sequence
  CD155 v122 IgV
PGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWL

SEQ ID NO: 1530 - protein, 116 aa, Artificial Sequence
  CD155 v123 IgV
PGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWL

SEQ ID NO: 1531 - protein, 116 aa, Artificial Sequence
  CD155 v124 IgV
PGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1532 - protein, 116 aa, Artificial Sequence
  CD155 v125 IgV
PGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWL

SEQ ID NO: 1533 - protein, 116 aa, Artificial Sequence
  CD155 v126 IgV
PGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWL

SEQ ID NO: 1534 - protein, 116 aa, Artificial Sequence
  CD155 v127 IgV
PGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWL

SEQ ID NO: 1535 - protein, 116 aa, Artificial Sequence
  CD155 v128 IgV
PGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWL

SEQ ID NO: 1536 - protein, 116 aa, Artificial Sequence
  CD155 v129 IgV
PGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWL

SEQ ID NO: 1537 - protein, 116 aa, Artificial Sequence
  CD155 v130 IgV
PGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1538 - protein, 116 aa, Artificial Sequence
  CD155 v131 IgV
PGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWL

SEQ ID NO: 1539 - protein, 116 aa, Artificial Sequence
  CD155 v132 IgV
PGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWL

SEQ ID NO: 1540 - protein, 116 aa, Artificial Sequence
  CD155 v133 IgV
PGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWL

SEQ ID NO: 1541 - protein, 116 aa, Artificial Sequence
  CD155 v134 IgV
PGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWL

SEQ ID NO: 1542 - protein, 116 aa, Artificial Sequence
  CD155 v135 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWL

SEQ ID NO: 1543 - protein, 116 aa, Artificial Sequence
  CD155 v136 IgV
PGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWL

SEQ ID NO: 1544 - protein, 116 aa, Artificial Sequence
  CD155 v137 IgV
PGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWL

SEQ ID NO: 1545 - protein, 116 aa, Artificial Sequence
  CD155 v138 IgV
PGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWL

SEQ ID NO: 1546 - protein, 116 aa, Artificial Sequence
  CD155 v139 IgV
PGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWL

SEQ ID NO: 1547 - protein, 116 aa, Artificial Sequence
  CD155 v140 IgV
PGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWL

SEQ ID NO: 1548 - protein, 116 aa, Artificial Sequence
  CD155 v141 IgV
PGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWL

SEQ ID NO: 1549 - protein, 116 aa, Artificial Sequence
  CD155 v142 IgV
PGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWL

SEQ ID NO: 1550 - protein, 122 aa, Artificial Sequence
  CD155 v120 IgV
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVL

SEQ ID NO: 1551 - protein, 122 aa, Artificial Sequence
  CD155 v121 IgV
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVL

SEQ ID NO: 1552 - protein, 122 aa, Artificial Sequence
  CD155 v122 IgV
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVL

SEQ ID NO: 1553 - protein, 122 aa, Artificial Sequence
  CD155 v123 IgV
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVL

SEQ ID NO: 1554 - protein, 122 aa, Artificial Sequence
  CD155 v124 IgV
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1555 - protein, 122 aa, Artificial Sequence
  CD155 v125 IgV
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVL

SEQ ID NO: 1556 - protein, 122 aa, Artificial Sequence
  CD155 v126 IgV
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVL

SEQ ID NO: 1557 - protein, 122 aa, Artificial Sequence
  CD155 v127 IgV
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1558 - protein, 122 aa, Artificial Sequence
  CD155 v128 IgV
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVL

SEQ ID NO: 1559 - protein, 122 aa, Artificial Sequence
  CD155 v129 IgV
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVL

SEQ ID NO: 1560 - protein, 122 aa, Artificial Sequence
  CD155 v130 IgV
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1561 - protein, 122 aa, Artificial Sequence
  CD155 v131 IgV
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVL

SEQ ID NO: 1562 - protein, 122 aa, Artificial Sequence
  CD155 v132 IgV
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVL

SEQ ID NO: 1563 - protein, 122 aa, Artificial Sequence
  CD155 v133 IgV
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVL

SEQ ID NO: 1564 - protein, 122 aa, Artificial Sequence
  CD155 v134 IgV
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVL

SEQ ID NO: 1565 - protein, 122 aa, Artificial Sequence
  CD155 v135 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVL

SEQ ID NO: 1566 - protein, 122 aa, Artificial Sequence
  CD155 v136 IgV
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVL

SEQ ID NO: 1567 - protein, 122 aa, Artificial Sequence
  CD155 v137 IgV
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVL

SEQ ID NO: 1568 - protein, 122 aa, Artificial Sequence
  CD155 v138 IgV
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVL

SEQ ID NO: 1569 - protein, 122 aa, Artificial Sequence
  CD155 v139 IgV
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1570 - protein, 122 aa, Artificial Sequence
  CD155 v140 IgV
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVL

SEQ ID NO: 1571 - protein, 122 aa, Artificial Sequence
  CD155 v141 IgV
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVL

SEQ ID NO: 1572 - protein, 122 aa, Artificial Sequence
  CD155 v142 IgV
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVL

SEQ ID NO: 1573 - protein, 323 aa, Artificial Sequence
  CD155 v120 ECD
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1574 - protein, 323 aa, Artificial Sequence
  CD155 v121 ECD
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1575 - protein, 323 aa, Artificial Sequence
  CD155 v122 ECD
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1576 - protein, 323 aa, Artificial Sequence
  CD155 v123 ECD
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1577 - protein, 323 aa, Artificial Sequence
  CD155 v124 ECD
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1578 - protein, 323 aa, Artificial Sequence
  CD155 v125 ECD
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1579 - protein, 323 aa, Artificial Sequence
  CD155 v126 ECD
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1580 - protein, 323 aa, Artificial Sequence
  CD155 v127 ECD
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1581 - protein, 323 aa, Artificial Sequence
  CD155 v128 ECD
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1582 - protein, 323 aa, Artificial Sequence
  CD155 v129 ECD
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1583 - protein, 323 aa, Artificial Sequence
  CD155 v130 ECD
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1584 - protein, 323 aa, Artificial Sequence
  CD155 v131 ECD
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1585 - protein, 323 aa, Artificial Sequence
  CD155 v132 ECD
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1586 - protein, 323 aa, Artificial Sequence
  CD155 v133 ECD
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1587 - protein, 323 aa, Artificial Sequence
  CD155 v134 ECD
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1588 - protein, 323 aa, Artificial Sequence
  CD155 v135 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1589 - protein, 323 aa, Artificial Sequence
  CD155 v136 ECD
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1590 - protein, 323 aa, Artificial Sequence
  CD155 v137 ECD
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1591 - protein, 323 aa, Artificial Sequence
  CD155 v138 ECD
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1592 - protein, 323 aa, Artificial Sequence
  CD155 v139 ECD
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1593 - protein, 323 aa, Artificial Sequence
  CD155 v140 ECD
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1594 - protein, 323 aa, Artificial Sequence
  CD155 v141 ECD
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1595 - protein, 323 aa, Artificial Sequence
  CD155 v142 ECD
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1596 - protein, 323 aa, Artificial Sequence
  CD155 v143 ECD
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1597 - protein, 116 aa, Artificial Sequence
  CD155 v143 IgV
PGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWL

SEQ ID NO: 1598 - protein, 122 aa, Artificial Sequence
  CD155 v143 IgV
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1599 - protein, 323 aa, Artificial Sequence
  CD155 v144 ECD
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1600 - protein, 323 aa, Artificial Sequence
  CD155 v145 ECD
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1601 - protein, 323 aa, Artificial Sequence
  CD155 v146 ECD
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1602 - protein, 323 aa, Artificial Sequence
  CD155 v147 ECD
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1603 - protein, 323 aa, Artificial Sequence
  CD155 v148 ECD
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1604 - protein, 323 aa, Artificial Sequence
  CD155 v149 ECD
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1605 - protein, 323 aa, Artificial Sequence
  CD155 v150 ECD
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1606 - protein, 323 aa, Artificial Sequence
  CD155 v151 ECD
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1607 - protein, 323 aa, Artificial Sequence
  CD155 v152 ECD
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1608 - protein, 323 aa, Artificial Sequence
  CD155 v153 ECD
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1609 - protein, 323 aa, Artificial Sequence
  CD155 v154 ECD
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1610 - protein, 323 aa, Artificial Sequence
  CD155 v155 ECD
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1611 - protein, 323 aa, Artificial Sequence
  CD155 v156 ECD
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1612 - protein, 323 aa, Artificial Sequence
  CD155 v157 ECD
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1613 - protein, 323 aa, Artificial Sequence
  CD155 v158 ECD
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1614 - protein, 323 aa, Artificial Sequence
  CD155 v159 ECD
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1615 - protein, 323 aa, Artificial Sequence
  CD155 v160 ECD
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1616 - protein, 323 aa, Artificial Sequence
  CD155 v161 ECD
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1617 - protein, 323 aa, Artificial Sequence
  CD155 v162 ECD
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1618 - protein, 323 aa, Artificial Sequence
  CD155 v163 ECD
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1619 - protein, 323 aa, Artificial Sequence
  CD155 v164 ECD
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1620 - protein, 323 aa, Artificial Sequence
  CD155 v165 ECD
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1621 - protein, 323 aa, Artificial Sequence
  CD155 v166 ECD
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1622 - protein, 323 aa, Artificial Sequence
  CD155 v167 ECD
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1623 - protein, 323 aa, Artificial Sequence
  CD155 v168 ECD
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1624 - protein, 323 aa, Artificial Sequence
  CD155 v169 ECD
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1625 - protein, 323 aa, Artificial Sequence
  CD155 v170 ECD
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1626 - protein, 323 aa, Artificial Sequence
  CD155 v171 ECD
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1627 - protein, 323 aa, Artificial Sequence
  CD155 v172 ECD
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1628 - protein, 323 aa, Artificial Sequence
  CD155 v173 ECD
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1629 - protein, 323 aa, Artificial Sequence
  CD155 v174 ECD
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1630 - protein, 323 aa, Artificial Sequence
  CD155 v175 ECD
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1631 - protein, 323 aa, Artificial Sequence
  CD155 v176 ECD
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1632 - protein, 323 aa, Artificial Sequence
  CD155 v177 ECD
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1633 - protein, 323 aa, Artificial Sequence
  CD155 v178 ECD
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1634 - protein, 323 aa, Artificial Sequence
  CD155 v179 ECD
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1635 - protein, 323 aa, Artificial Sequence
  CD155 v180 ECD
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1636 - protein, 323 aa, Artificial Sequence
  CD155 v181 ECD
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1637 - protein, 323 aa, Artificial Sequence
  CD155 v182 ECD
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1638 - protein, 323 aa, Artificial Sequence
  CD155 v183 ECD
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1639 - protein, 323 aa, Artificial Sequence
  CD155 v184 ECD
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1640 - protein, 323 aa, Artificial Sequence
  CD155 v185 ECD
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1641 - protein, 323 aa, Artificial Sequence
  CD155 v186 ECD
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1642 - protein, 323 aa, Artificial Sequence
  CD155 v187 ECD
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1643 - protein, 323 aa, Artificial Sequence
  CD155 v188 ECD
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1644 - protein, 323 aa, Artificial Sequence
  CD155 v189 ECD
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1645 - protein, 116 aa, Artificial Sequence
  CD155 v144 IgV
PGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWL

SEQ ID NO: 1646 - protein, 116 aa, Artificial Sequence
  CD155 v145 IgV
PGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWL

SEQ ID NO: 1647 - protein, 116 aa, Artificial Sequence
  CD155 v146 IgV
PGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWL

SEQ ID NO: 1648 - protein, 116 aa, Artificial Sequence
  CD155 v147 IgV
PGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWL

SEQ ID NO: 1649 - protein, 116 aa, Artificial Sequence
  CD155 v148 IgV
PGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWL

SEQ ID NO: 1650 - protein, 116 aa, Artificial Sequence
  CD155 v149 IgV
PGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWL

SEQ ID NO: 1651 - protein, 116 aa, Artificial Sequence
  CD155 v150 IgV
PGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWL

SEQ ID NO: 1652 - protein, 116 aa, Artificial Sequence
  CD155 v151 IgV
PGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWL

SEQ ID NO: 1653 - protein, 116 aa, Artificial Sequence
  CD155 v152 IgV
PGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWL

SEQ ID NO: 1654 - protein, 116 aa, Artificial Sequence
  CD155 v153 IgV
PGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWL

SEQ ID NO: 1655 - protein, 116 aa, Artificial Sequence
  CD155 v154 IgV
PGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWL

SEQ ID NO: 1656 - protein, 116 aa, Artificial Sequence
  CD155 v155 IgV
PGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWL

SEQ ID NO: 1657 - protein, 116 aa, Artificial Sequence
  CD155 v156 IgV
PGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWL

SEQ ID NO: 1658 - protein, 116 aa, Artificial Sequence
  CD155 v157 IgV
PGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWL

SEQ ID NO: 1659 - protein, 116 aa, Artificial Sequence
  CD155 v158 IgV
PGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWL

SEQ ID NO: 1660 - protein, 116 aa, Artificial Sequence
  CD155 v159 IgV
PGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWL

SEQ ID NO: 1661 - protein, 116 aa, Artificial Sequence
  CD155 v160 IgV
PGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWL

SEQ ID NO: 1662 - protein, 116 aa, Artificial Sequence
  CD155 v161 IgV
PGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWL

SEQ ID NO: 1663 - protein, 116 aa, Artificial Sequence
  CD155 v162 IgV
PGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWL

SEQ ID NO: 1664 - protein, 116 aa, Artificial Sequence
  CD155 v163 IgV
PGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWL

SEQ ID NO: 1665 - protein, 116 aa, Artificial Sequence
  CD155 v164 IgV
PGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWL

SEQ ID NO: 1666 - protein, 116 aa, Artificial Sequence
  CD155 v165 IgV
PGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWL

SEQ ID NO: 1667 - protein, 116 aa, Artificial Sequence
  CD155 v166 IgV
PGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWL

SEQ ID NO: 1668 - protein, 116 aa, Artificial Sequence
  CD155 v167 IgV
PGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWL

SEQ ID NO: 1669 - protein, 116 aa, Artificial Sequence
  CD155 v168 IgV
PGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWL

SEQ ID NO: 1670 - protein, 116 aa, Artificial Sequence
  CD155 v169 IgV
PGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWL

SEQ ID NO: 1671 - protein, 116 aa, Artificial Sequence
  CD155 v170 IgV
PGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWL

SEQ ID NO: 1672 - protein, 116 aa, Artificial Sequence
  CD155 v171 IgV
PGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWL

SEQ ID NO: 1673 - protein, 116 aa, Artificial Sequence
  CD155 v172 IgV
PGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWL

SEQ ID NO: 1674 - protein, 116 aa, Artificial Sequence
  CD155 v173 IgV
PGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWL

SEQ ID NO: 1675 - protein, 116 aa, Artificial Sequence
  CD155 v174 IgV
PGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWL

SEQ ID NO: 1676 - protein, 116 aa, Artificial Sequence
  CD155 v175 IgV
PGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWL

SEQ ID NO: 1677 - protein, 116 aa, Artificial Sequence
  CD155 v176 IgV
PGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWL

SEQ ID NO: 1678 - protein, 116 aa, Artificial Sequence
  CD155 v177 IgV
PGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWL

SEQ ID NO: 1679 - protein, 116 aa, Artificial Sequence
  CD155 v178 IgV
PGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWL

SEQ ID NO: 1680 - protein, 116 aa, Artificial Sequence
  CD155 v179 IgV
PGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWL

SEQ ID NO: 1681 - protein, 116 aa, Artificial Sequence
  CD155 v180 IgV
PGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWL

SEQ ID NO: 1682 - protein, 116 aa, Artificial Sequence
  CD155 v181 IgV
PGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWL

SEQ ID NO: 1683 - protein, 116 aa, Artificial Sequence
  CD155 v182 IgV
PGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWL

SEQ ID NO: 1684 - protein, 116 aa, Artificial Sequence
  CD155 v183 IgV
PGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWL

SEQ ID NO: 1685 - protein, 116 aa, Artificial Sequence
  CD155 v184 IgV
PGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWL

SEQ ID NO: 1686 - protein, 116 aa, Artificial Sequence
  CD155 v185 IgV
PGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWL

SEQ ID NO: 1687 - protein, 116 aa, Artificial Sequence
  CD155 v186 IgV
PGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWL

SEQ ID NO: 1688 - protein, 116 aa, Artificial Sequence
  CD155 v187 IgV
PGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWL

SEQ ID NO: 1689 - protein, 116 aa, Artificial Sequence
  CD155 v188 IgV
PGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWL

SEQ ID NO: 1690 - protein, 116 aa, Artificial Sequence
  CD155 v189 IgV
PGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWL

SEQ ID NO: 1691 - protein, 122 aa, Artificial Sequence
  CD155 v144 IgV
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVL

SEQ ID NO: 1692 - protein, 122 aa, Artificial Sequence
  CD155 v145 IgV
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVL

SEQ ID NO: 1693 - protein, 122 aa, Artificial Sequence
  CD155 v146 IgV
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVL

SEQ ID NO: 1694 - protein, 122 aa, Artificial Sequence
  CD155 v147 IgV
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVL

SEQ ID NO: 1695 - protein, 122 aa, Artificial Sequence
  CD155 v148 IgV
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVL

SEQ ID NO: 1696 - protein, 122 aa, Artificial Sequence
  CD155 v149 IgV
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVL

SEQ ID NO: 1697 - protein, 122 aa, Artificial Sequence
  CD155 v150 IgV
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVL

SEQ ID NO: 1698 - protein, 122 aa, Artificial Sequence
  CD155 v151 IgV
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVL

SEQ ID NO: 1699 - protein, 122 aa, Artificial Sequence
  CD155 v152 IgV
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVL

SEQ ID NO: 1700 - protein, 122 aa, Artificial Sequence
  CD155 v153 IgV
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVL

SEQ ID NO: 1701 - protein, 122 aa, Artificial Sequence
  CD155 v154 IgV
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVL

SEQ ID NO: 1702 - protein, 122 aa, Artificial Sequence
  CD155 v155 IgV
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVL

SEQ ID NO: 1703 - protein, 122 aa, Artificial Sequence
  CD155 v156 IgV
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVL

SEQ ID NO: 1704 - protein, 122 aa, Artificial Sequence
  CD155 v157 IgV
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVL

SEQ ID NO: 1705 - protein, 122 aa, Artificial Sequence
  CD155 v158 IgV
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVL

SEQ ID NO: 1706 - protein, 122 aa, Artificial Sequence
  CD155 v159 IgV
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVL

SEQ ID NO: 1707 - protein, 122 aa, Artificial Sequence
  CD155 v160 IgV
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVL

SEQ ID NO: 1708 - protein, 122 aa, Artificial Sequence
  CD155 v161 IgV
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVL

SEQ ID NO: 1709 - protein, 122 aa, Artificial Sequence
  CD155 v162 IgV
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVL

SEQ ID NO: 1710 - protein, 122 aa, Artificial Sequence
  CD155 v163 IgV
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVL

SEQ ID NO: 1711 - protein, 122 aa, Artificial Sequence
  CD155 v164 IgV
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVL

SEQ ID NO: 1712 - protein, 122 aa, Artificial Sequence
  CD155 v165 IgV
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVL

SEQ ID NO: 1713 - protein, 122 aa, Artificial Sequence
  CD155 v166 IgV
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVL

SEQ ID NO: 1714 - protein, 122 aa, Artificial Sequence
  CD155 v167 IgV
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVL

SEQ ID NO: 1715 - protein, 122 aa, Artificial Sequence
  CD155 v168 IgV
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVL

SEQ ID NO: 1716 - protein, 122 aa, Artificial Sequence
  CD155 v169 IgV
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVL

SEQ ID NO: 1717 - protein, 122 aa, Artificial Sequence
  CD155 v170 IgV
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVL

SEQ ID NO: 1718 - protein, 122 aa, Artificial Sequence
  CD155 v171 IgV
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVL

SEQ ID NO: 1719 - protein, 122 aa, Artificial Sequence
  CD155 v172 IgV
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVL

SEQ ID NO: 1720 - protein, 122 aa, Artificial Sequence
  CD155 v173 IgV
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVL

SEQ ID NO: 1721 - protein, 122 aa, Artificial Sequence
  CD155 v174 IgV
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVL

SEQ ID NO: 1722 - protein, 122 aa, Artificial Sequence
  CD155 v175 IgV
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVL

SEQ ID NO: 1723 - protein, 122 aa, Artificial Sequence
  CD155 v176 IgV
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVL

SEQ ID NO: 1724 - protein, 122 aa, Artificial Sequence
  CD155 v177 IgV
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVL

SEQ ID NO: 1725 - protein, 122 aa, Artificial Sequence
  CD155 v178 IgV
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVL

SEQ ID NO: 1726 - protein, 122 aa, Artificial Sequence
  CD155 v179 IgV
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVL

SEQ ID NO: 1727 - protein, 122 aa, Artificial Sequence
  CD155 v180 IgV
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVL

SEQ ID NO: 1728 - protein, 122 aa, Artificial Sequence
  CD155 v181 IgV
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVL

SEQ ID NO: 1729 - protein, 122 aa, Artificial Sequence
  CD155 v182 IgV
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVL

SEQ ID NO: 1730 - protein, 122 aa, Artificial Sequence
  CD155 v183 IgV
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVL

SEQ ID NO: 1731 - protein, 122 aa, Artificial Sequence
  CD155 v184 IgV
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVL

SEQ ID NO: 1732 - protein, 122 aa, Artificial Sequence
  CD155 v185 IgV
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVL

SEQ ID NO: 1733 - protein, 122 aa, Artificial Sequence
  CD155 v186 IgV
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVL

SEQ ID NO: 1734 - protein, 122 aa, Artificial Sequence
  CD155 v187 IgV
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVL

SEQ ID NO: 1735 - protein, 122 aa, Artificial Sequence
  CD155 v188 IgV
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVL

SEQ ID NO: 1736 - protein, 122 aa, Artificial Sequence
  CD155 v189 IgV
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVL

SEQ ID NO: 1737 - protein, 231 aa, Artificial Sequence
  Stack Fc Lysine removed (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1738 - protein, 231 aa, Artificial Sequence
  Fc (C5S (C220S), R77C, (R292C),  N82G (N297G), V87C (V302C), L232del (K447del))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1739 - protein, 231 aa, Artificial Sequence
  Fc with C220S/L234A/L235E/G237A/K447del
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1740 - protein, 230 aa, Artificial Sequence
  Fc with C220S/E233P/L234V/L235A/G236del/S267K/K447del
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1741 - protein, 7 aa, Artificial Sequence
  Linker
GSGGGGS

SEQ ID NO: 1742 - protein, 5 aa, Artificial Sequence
  4GS Linker
GGGGS

SEQ ID NO: 1743 - protein, 221 aa, Artificial Sequence
  PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1744 - protein, 221 aa, Artificial Sequence
  PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1745 - protein, 221 aa, Artificial Sequence
  PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1746 - protein, 221 aa, Artificial Sequence
  PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1747 - protein, 221 aa, Artificial Sequence
  PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1748 - protein, 221 aa, Artificial Sequence
  PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1749 - protein, 221 aa, Artificial Sequence
  PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1750 - protein, 221 aa, Artificial Sequence
  PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1751 - protein, 221 aa, Artificial Sequence
  PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1752 - protein, 221 aa, Artificial Sequence
  PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1753 - protein, 221 aa, Artificial Sequence
  PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1754 - protein, 221 aa, Artificial Sequence
  PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1755 - protein, 221 aa, Artificial Sequence
  PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1756 - protein, 221 aa, Artificial Sequence
  PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1757 - protein, 221 aa, Artificial Sequence
  PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1758 - protein, 221 aa, Artificial Sequence
  PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1759 - protein, 221 aa, Artificial Sequence
  PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1760 - protein, 221 aa, Artificial Sequence
  PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1761 - protein, 221 aa, Artificial Sequence
  PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1762 - protein, 221 aa, Artificial Sequence
  PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1763 - protein, 221 aa, Artificial Sequence
  PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1764 - protein, 221 aa, Artificial Sequence
  PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1765 - protein, 221 aa, Artificial Sequence
  PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1766 - protein, 221 aa, Artificial Sequence
  PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1767 - protein, 221 aa, Artificial Sequence
  PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1768 - protein, 221 aa, Artificial Sequence
  PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1769 - protein, 221 aa, Artificial Sequence
  PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1770 - protein, 221 aa, Artificial Sequence
  PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1771 - protein, 221 aa, Artificial Sequence
  PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1772 - protein, 221 aa, Artificial Sequence
  PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1773 - protein, 221 aa, Artificial Sequence
  PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1774 - protein, 221 aa, Artificial Sequence
  PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1775 - protein, 221 aa, Artificial Sequence
  PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1776 - protein, 221 aa, Artificial Sequence
  PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1777 - protein, 221 aa, Artificial Sequence
  PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1778 - protein, 221 aa, Artificial Sequence
  PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1779 - protein, 221 aa, Artificial Sequence
  PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1780 - protein, 221 aa, Artificial Sequence
  PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1781 - protein, 221 aa, Artificial Sequence
  PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1782 - protein, 221 aa, Artificial Sequence
  PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1783 - protein, 221 aa, Artificial Sequence
  PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1784 - protein, 221 aa, Artificial Sequence
  PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1785 - protein, 221 aa, Artificial Sequence
  PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1786 - protein, 221 aa, Artificial Sequence
  PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1787 - protein, 221 aa, Artificial Sequence
  PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1788 - protein, 221 aa, Artificial Sequence
  PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1789 - protein, 221 aa, Artificial Sequence
  PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1790 - protein, 221 aa, Artificial Sequence
  PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1791 - protein, 221 aa, Artificial Sequence
  PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1792 - protein, 221 aa, Artificial Sequence
  PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1793 - protein, 221 aa, Artificial Sequence
  PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1794 - protein, 221 aa, Artificial Sequence
  PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1795 - protein, 221 aa, Artificial Sequence
  PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1796 - protein, 221 aa, Artificial Sequence
  PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1797 - protein, 221 aa, Artificial Sequence; identical to SEQ ID NO: 1753
  PD-L1 ECD v55

SEQ ID NO: 1798 - protein, 221 aa, Artificial Sequence
  PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1799 - protein, 221 aa, Artificial Sequence
  PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1800 - protein, 221 aa, Artificial Sequence
  PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1801 - protein, 221 aa, Artificial Sequence
  PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1802 - protein, 222 aa, Artificial Sequence
  PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1803 - protein, 221 aa, Artificial Sequence
  PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1804 - protein, 221 aa, Artificial Sequence
  PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1805 - protein, 221 aa, Artificial Sequence
  PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1806 - protein, 221 aa, Artificial Sequence
  PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1807 - protein, 221 aa, Artificial Sequence
  PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1808 - protein, 222 aa, Artificial Sequence
  PD-L1 ECD v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1809 - protein, 221 aa, Artificial Sequence
  PD-L1 ECD v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1810 - protein, 108 aa, Artificial Sequence
  PD-L1 IgV 66
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKV

SEQ ID NO: 1811 - protein, 115 aa, Artificial Sequence
  PD-L1 IgV v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNA

SEQ ID NO: 1812 - protein, 221 aa, Homo sapiens [sequence omitted]

SEQ ID NO: 1813 - protein, 221 aa, Artificial Sequence
  PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1814 - protein, 221 aa, Artificial Sequence
  PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNERT

SEQ ID NO: 1815 - protein, 221 aa, Artificial Sequence
  PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNERT

SEQ ID NO: 1816 - protein, 221 aa, Artificial Sequence
  PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNERT

SEQ ID NO: 1817 - protein, 221 aa, Artificial Sequence
  PD-L1 ECD v71
FTVTVPKDLYVVEYGSNMTIERKFPVEKQLDLAALIVYWEMEDKNIIQFVHGEEDLKVQHSSYRLRARLLKDQLSLGNAALQITDVKLQDAGVYRCMISYGGADYKRITVKVNAPYNKINQRISVVDPVTSEHELTCQAEGYPQAEVIWTSSDHQVLSGKTTTTNSKREEKLFNVTSTLRINTTTNEIFYCTFRGLDPENNQTAELVIPELPLAHPPNERL

SEQ ID NO: 1818 - protein, 221 aa, Artificial Sequence
  PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNERT

SEQ ID NO: 1819 - protein, 221 aa, Artificial Sequence
  PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNERT

SEQ ID NO: 1820 - protein, 221 aa, Artificial Sequence
  PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNERT

SEQ ID NO: 1821 - protein, 221 aa, Artificial Sequence
  PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1822 - protein, 221 aa, Artificial Sequence
  PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1823 - protein, 221 aa, Artificial Sequence
  PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNERT

SEQ ID NO: 1824 - protein, 221 aa, Artificial Sequence
  PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNERT

SEQ ID NO: 1825 - protein, 221 aa, Artificial Sequence
  PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1826 - protein, 221 aa, Artificial Sequence
  PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1827 - protein, 221 aa, Artificial Sequence
  PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1828 - protein, 221 aa, Artificial Sequence
  PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1829 - protein, 221 aa, Artificial Sequence
  PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1830 - protein, 221 aa, Artificial Sequence
  PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1831 - protein, 221 aa, Artificial Sequence
  PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1832 - protein, 221 aa, Artificial Sequence
  PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1833 - protein, 221 aa, Artificial Sequence
  PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1834 - protein, 221 aa, Artificial Sequence
  PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNERT

SEQ ID NO: 1835 - protein, 221 aa, Artificial Sequence
  PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNERT

SEQ ID NO: 1836 - protein, 221 aa, Artificial Sequence
  PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNERT

SEQ ID NO: 1837 - protein, 221 aa, Artificial Sequence
  PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNERT

SEQ ID NO: 1838 - protein, 221 aa, Artificial Sequence
  PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNERT

SEQ ID NO: 1839 - protein, 221 aa, Artificial Sequence
  PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1840 - protein, 221 aa, Artificial Sequence
  PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1841 - protein, 221 aa, Artificial Sequence
  PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1842 - protein, 221 aa, Artificial Sequence
  PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNERT

SEQ ID NO: 1843 - protein, 221 aa, Artificial Sequence
  PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1844 - protein, 221 aa, Artificial Sequence
  PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1845 - protein, 221 aa, Artificial Sequence
  PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNERT

SEQ ID NO: 1846 - protein, 221 aa, Artificial Sequence
  PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1847 - protein, 221 aa, Artificial Sequence
  PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNERT

SEQ ID NO: 1848 - protein, 221 aa, Artificial Sequence
  PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1849 - protein, 221 aa, Artificial Sequence
  PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1850 - protein, 221 aa, Artificial Sequence
  PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNERT

SEQ ID NO: 1851 - protein, 221 aa, Artificial Sequence
  PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1852 - protein, 221 aa, Artificial Sequence
  PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1853 - protein, 221 aa, Artificial Sequence
  PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNERT

SEQ ID NO: 1854 - protein, 221 aa, Artificial Sequence
  PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1855 - protein, 221 aa, Artificial Sequence
  PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNERT

SEQ ID NO: 1856 - protein, 221 aa, Artificial Sequence
  PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1857 - protein, 221 aa, Artificial Sequence
  PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNERT

SEQ ID NO: 1858 - protein, 221 aa, Artificial Sequence
  PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1859 - protein, 221 aa, Artificial Sequence
  PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1860 - protein, 221 aa, Artificial Sequence
  PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1861 - protein, 221 aa, Artificial Sequence
  PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1862 - protein, 221 aa, Artificial Sequence
  PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1863 - protein, 221 aa, Artificial Sequence
  PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1864 - protein, 221 aa, Artificial Sequence
  PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1865 - protein, 221 aa, Artificial Sequence
  PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1866 - protein, 221 aa, Artificial Sequence
  PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNERT

SEQ ID NO: 1867 - protein, 221 aa, Artificial Sequence
  PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNERT

SEQ ID NO: 1868 - protein, 221 aa, Artificial Sequence
  PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNERT

SEQ ID NO: 1869 - protein, 221 aa, Artificial Sequence
  PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNERT

SEQ ID NO: 1870 - protein, 221 aa, Artificial Sequence
  PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1871 - protein, 221 aa, Artificial Sequence
  PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1872 - protein, 221 aa, Artificial Sequence
  PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNERT

SEQ ID NO: 1873 - protein, 221 aa, Artificial Sequence
  PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1874 - protein, 221 aa, Artificial Sequence
  PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1875 - protein, 221 aa, Artificial Sequence
  PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1876 - protein, 221 aa, Artificial Sequence
  PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNERT

SEQ ID NO: 1877 - protein, 221 aa, Artificial Sequence
  PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1878 - protein, 221 aa, Artificial Sequence
  PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNERT

SEQ ID NO: 1879 - protein, 221 aa, Artificial Sequence
  PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1880 - protein, 221 aa, Artificial Sequence
  PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNERT

SEQ ID NO: 1881 - protein, 221 aa, Artificial Sequence
  PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1882 - protein, 221 aa, Artificial Sequence
  PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1883 - protein, 221 aa, Artificial Sequence
  PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1884 - protein, 221 aa, Artificial Sequence
  PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNERT

SEQ ID NO: 1885 - protein, 221 aa, Artificial Sequence
  PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNERT

SEQ ID NO: 1886 - protein, 221 aa, Artificial Sequence
  PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNERT

SEQ ID NO: 1887 - protein, 221 aa, Artificial Sequence
  PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNERT

SEQ ID NO: 1888 - protein, 221 aa, Artificial Sequence
  PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1889 - protein, 221 aa, Artificial Sequence
  PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNERT

SEQ ID NO: 1890 - protein, 221 aa, Artificial Sequence
  PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1891 - protein, 221 aa, Artificial Sequence
  PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNERT

SEQ ID NO: 1892 - protein, 221 aa, Artificial Sequence
  PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNERT

SEQ ID NO: 1893 - protein, 221 aa, Artificial Sequence
  PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNERT

SEQ ID NO: 1894 - protein, 221 aa, Artificial Sequence
  PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNERT

SEQ ID NO: 1895 - protein, 221 aa, Artificial Sequence
  PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1896 - protein, 221 aa, Artificial Sequence
  PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNERT

SEQ ID NO: 1897 - protein, 221 aa, Artificial Sequence
  PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1898 - protein, 221 aa, Artificial Sequence
  PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1899 - protein, 221 aa, Artificial Sequence
  PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNERT

SEQ ID NO: 1900 - protein, 221 aa, Artificial Sequence
  PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1901 - protein, 221 aa, Artificial Sequence
  PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNERT

SEQ ID NO: 1902 - protein, 221 aa, Artificial Sequence
  PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNERT

SEQ ID NO: 1903 - protein, 220 aa, Artificial Sequence
  PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1904 - protein, 220 aa, Artificial Sequence
  PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNER

SEQ ID NO: 1905 - protein, 220 aa, Artificial Sequence
  PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNER

SEQ ID NO: 1906 - protein, 220 aa, Artificial Sequence
  PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNER

SEQ ID NO: 1907 - protein, 220 aa, Artificial Sequence
  PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNER

SEQ ID NO: 1908 - protein, 220 aa, Artificial Sequence
  PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNER

SEQ ID NO: 1909 - protein, 220 aa, Artificial Sequence
  PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNER

SEQ ID NO: 1910 - protein, 220 aa, Artificial Sequence
  PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1911 - protein, 220 aa, Artificial Sequence
  PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1912 - protein, 220 aa, Artificial Sequence
  PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNER

SEQ ID NO: 1913 - protein, 220 aa, Artificial Sequence
  PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNER

SEQ ID NO: 1914 - protein, 220 aa, Artificial Sequence
  PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1915 - protein, 220 aa, Artificial Sequence
  PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1916 - protein, 220 aa, Artificial Sequence
  PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1917 - protein, 220 aa, Artificial Sequence
  PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1918 - protein, 220 aa, Artificial Sequence
  PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1919 - protein, 220 aa, Artificial Sequence
  PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1920 - protein, 220 aa, Artificial Sequence
  PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1921 - protein, 220 aa, Artificial Sequence
  PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1922 - protein, 220 aa, Artificial Sequence
  PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1923 - protein, 220 aa, Artificial Sequence
  PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNER

SEQ ID NO: 1924 - protein, 220 aa, Artificial Sequence
  PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNER

SEQ ID NO: 1925 - protein, 220 aa, Artificial Sequence
  PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNER

SEQ ID NO: 1926 - protein, 220 aa, Artificial Sequence
  PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNER

SEQ ID NO: 1927 - protein, 220 aa, Artificial Sequence
  PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNER

SEQ ID NO: 1928 - protein, 220 aa, Artificial Sequence
  PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1929 - protein, 220 aa, Artificial Sequence
  PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1930 - protein, 220 aa, Artificial Sequence
  PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1931 - protein, 220 aa, Artificial Sequence
  PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNER

SEQ ID NO: 1932 - protein, 220 aa, Artificial Sequence
  PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1933 - protein, 220 aa, Artificial Sequence
  PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1934 - protein, 220 aa, Artificial Sequence
  PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNER

SEQ ID NO: 1935 - protein, 220 aa, Artificial Sequence
  PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1936 - protein, 220 aa, Artificial Sequence
  PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNER

SEQ ID NO: 1937 - protein, 220 aa, Artificial Sequence
  PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1938 - protein, 220 aa, Artificial Sequence
  PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1939 - protein, 220 aa, Artificial Sequence
  PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNER

SEQ ID NO: 1940 - protein, 220 aa, Artificial Sequence
  PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1941 - protein, 220 aa, Artificial Sequence
  PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1942 - protein, 220 aa, Artificial Sequence
  PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNER

SEQ ID NO: 1943 - protein, 220 aa, Artificial Sequence
  PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1944 - protein, 220 aa, Artificial Sequence
  PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNER

SEQ ID NO: 1945 - protein, 220 aa, Artificial Sequence
  PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1946 - protein, 220 aa, Artificial Sequence
  PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNER

SEQ ID NO: 1947 - protein, 220 aa, Artificial Sequence
  PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1948 - protein, 220 aa, Artificial Sequence
  PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1949 - protein, 220 aa, Artificial Sequence
  PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1950 - protein, 220 aa, Artificial Sequence
  PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1951 - protein, 220 aa, Artificial Sequence
  PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1952 - protein, 220 aa, Artificial Sequence
  PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1953 - protein, 220 aa, Artificial Sequence
  PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1954 - protein, 220 aa, Artificial Sequence
  PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1955 - protein, 220 aa, Artificial Sequence
  PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNER

SEQ ID NO: 1956 - protein, 220 aa, Artificial Sequence
  PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNER

SEQ ID NO: 1957 - protein, 220 aa, Artificial Sequence
  PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNER

SEQ ID NO: 1958 - protein, 220 aa, Artificial Sequence
  PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNER

SEQ ID NO: 1959 - protein, 220 aa, Artificial Sequence
  PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1960 - protein, 220 aa, Artificial Sequence
  PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1961 - protein, 220 aa, Artificial Sequence
  PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNER

SEQ ID NO: 1962 - protein, 220 aa, Artificial Sequence
  PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1963 - protein, 220 aa, Artificial Sequence
  PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1964 - protein, 220 aa, Artificial Sequence
  PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1965 - protein, 220 aa, Artificial Sequence
  PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNER

SEQ ID NO: 1966 - protein, 220 aa, Artificial Sequence
  PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1967 - protein, 220 aa, Artificial Sequence
  PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNER

SEQ ID NO: 1968 - protein, 220 aa, Artificial Sequence
  PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1969 - protein, 220 aa, Artificial Sequence
  PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNER

SEQ ID NO: 1970 - protein, 220 aa, Artificial Sequence
  PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1971 - protein, 220 aa, Artificial Sequence
  PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1972 - protein, 220 aa, Artificial Sequence
  PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1973 - protein, 220 aa, Artificial Sequence
  PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNER

SEQ ID NO: 1974 - protein, 220 aa, Artificial Sequence
  PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNER

SEQ ID NO: 1975 - protein, 220 aa, Artificial Sequence
  PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNER

SEQ ID NO: 1976 - protein, 220 aa, Artificial Sequence
  PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNER

SEQ ID NO: 1977 - protein, 220 aa, Artificial Sequence
  PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1978 - protein, 220 aa, Artificial Sequence
  PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNER

SEQ ID NO: 1979 - protein, 220 aa, Artificial Sequence
  PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1980 - protein, 220 aa, Artificial Sequence
  PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNER

SEQ ID NO: 1981 - protein, 220 aa, Artificial Sequence
  PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNER

SEQ ID NO: 1982 - protein, 220 aa, Artificial Sequence
  PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNER

SEQ ID NO: 1983 - protein, 220 aa, Artificial Sequence
  PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNER

SEQ ID NO: 1984 - protein, 220 aa, Artificial Sequence
  PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1985 - protein, 220 aa, Artificial Sequence
  PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNER

SEQ ID NO: 1986 - protein, 220 aa, Artificial Sequence
  PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1987 - protein, 220 aa, Artificial Sequence
  PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1988 - protein, 220 aa, Artificial Sequence
  PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNER

SEQ ID NO: 1989 - protein, 220 aa, Artificial Sequence
  PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1990 - protein, 220 aa, Artificial Sequence
  PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNER

SEQ ID NO: 1991 - protein, 220 aa, Artificial Sequence
  PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNER

SEQ ID NO: 1992 - protein, 107 aa, Artificial Sequence
  PD-L1 IgV v67
PKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKV

SEQ ID NO: 1993 - protein, 107 aa, Artificial Sequence
  PD-L1 IgV v75
PKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKV

SEQ ID NO: 1994 - protein, 107 aa, Artificial Sequence
  PD-L1 IgV v80
PKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKV

SEQ ID NO: 1995 - protein, 107 aa, Artificial Sequence
  PD-L1 IgV v81
PKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEV

SEQ ID NO: 1996 - protein, 107 aa, Artificial Sequence
  PD-L1 IgV v82
PKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKV

SEQ ID NO: 1997 - protein, 107 aa, Artificial Sequence
  PD-L1 IgV v87
PKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKV

SEQ ID NO: 1998 - protein, 107 aa, Artificial Sequence
  PD-L1 IgV v94
PKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEV

SEQ ID NO: 1999 - protein, 107 aa, Artificial Sequence
  PD-L1 IgV v98
PKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEV

SEQ ID NO: 2000 - protein, 107 aa, Artificial Sequence
  PD-L1 IgV v100
PKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEV

SEQ ID NO: 2001 - protein, 107 aa, Artificial Sequence
  PD-L1 IgV v102
PKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 2002 - protein, 107 aa, Artificial Sequence
  PD-L1 IgV v103
PKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 2003 - protein, 107 aa, Artificial Sequence
  PD-L1 IgV v110
PKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKV

SEQ ID NO: 2004 - protein, 107 aa, Artificial Sequence
  PD-L1 IgV v118
PKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKV

SEQ ID NO: 2005 - protein, 107 aa, Artificial Sequence
  PD-L1 IgV v127
PKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKV

SEQ ID NO: 2006 - protein, 107 aa, Artificial Sequence
  PD-L1 IgV v152
PKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKV

SEQ ID NO: 2007 - protein, 114 aa, Artificial Sequence
  PD-L1 IgV v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNA

SEQ ID NO: 2008 - protein, 114 aa, Artificial Sequence
  PD-L1 IgV v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNA

SEQ ID NO: 2009 - protein, 114 aa, Artificial Sequence
  PD-L1 IgV v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNA

SEQ ID NO: 2010 - protein, 114 aa, Artificial Sequence
  PD-L1 IgV v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 2011 - protein, 114 aa, Artificial Sequence
  PD-L1 IgV v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNA

SEQ ID NO: 2012 - protein, 114 aa, Artificial Sequence
  PD-L1 IgV v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNA

SEQ ID NO: 2013 - protein, 114 aa, Artificial Sequence
  PD-L1 IgV v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNA

SEQ ID NO: 2014 - protein, 114 aa, Artificial Sequence
  PD-L1 IgV v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNA

SEQ ID NO: 2015 - protein, 114 aa, Artificial Sequence
  PD-L1 IgV v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 2016 - protein, 114 aa, Artificial Sequence
  PD-L1 IgV v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 2017 - protein, 114 aa, Artificial Sequence
  PD-L1 IgV v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 2018 - protein, 114 aa, Artificial Sequence
  PD-L1 IgV v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNA

SEQ ID NO: 2019 - protein, 114 aa, Artificial Sequence
  PD-L1 IgV v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNA

SEQ ID NO: 2020 - protein, 114 aa, Artificial Sequence
  PD-L1 IgV v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNA

SEQ ID NO: 2021 - protein, 114 aa, Artificial Sequence
  PD-L1 IgV v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNA

SEQ ID NO: 2022 - protein, 68 aa, Artificial Sequence
  CD8 hinge and transmembrane domain
KPTTTPAPRPPTPAPTIASQPLSLRPEACRPAAGGAVHTRGLDFACDIYIWAPLAGTCGVLLLSLVIT

SEQ ID NO: 2023 - protein, 431 aa, Artificial Sequence
  antiCD19 chimeric antigen receptor CAR-2
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2024 - protein, 707 aa, Artificial Sequence
  antiCD19 chimeric antigen receptor CAR-2
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 2025 - DNA, 8708 bp, Artificial Sequence
  anti-CD19 chimeric antigen receptor CAR-2
agcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagaagcttgatatcgaattcccacggggttggacgcgtaggaacagagaaacaggagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacttccatagaaggatcccctgcaggtaatacgactcactatagggtccactgccgccaccatggctctgcctgtgacagctctgctgctgcctctggccctgctgctccatgccgccagacccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcgccaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagtggcgagggcagaggaagtctgctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgca

SEQ ID NO: 2026 - protein, 428 aa, Artificial Sequence
  antiCD19 chimeric antigen receptor CAR-1
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2027 - protein, 706 aa, Artificial Sequence
  antiCD19 chimeric antigen receptor CAR-1
MALPVTALLLPLALLLHAARPGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2028 - protein, 232 aa, Artificial Sequence
  Blue fluorescent protein
SRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2029 - protein, 18 aa, Artificial Sequence
  T2A
EGRGSLLTCGDVEENPGP

SEQ ID NO: 2030 - protein, 5 aa, Artificial Sequence
  EAAAK Linker
EAAAK

SEQ ID NO: 2031 - protein, 15 aa, Artificial Sequence
  3x EAAAK Linker
EAAAKEAAAKEAAAK

SEQ ID NO: 2032 - protein, 25 aa, Artificial Sequence
  5x EAAAK Linker
EAAAKEAAAKEAAAKEAAAKEAAAK

SEQ ID NO: 2033 - protein, 400 aa, Artificial Sequence
  PAS
ASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPA

SEQ ID NO: 2034 - protein, 8 aa, Artificial Sequence
  Flag tag
DYKDDDDK

SEQ ID NO: 2035 - protein, 237 aa, Artificial Sequence
  eGFP
SKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 2036 - protein, 237 aa, Artificial Sequence
  Green fluorescent protein
SKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 2037 - protein, 239 aa, Artificial Sequence
  eGFP
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 2038 - protein, 22 aa, Artificial Sequence
  P2A
GSGATNFSLLKQAGDVEENPGP

SEQ ID NO: 2039 - protein, 107 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKAD

SEQ ID NO: 2040 - protein, 17 aa, Artificial Sequence
  GS(G4S)3 linker
GSGGGGSGGGGSGGGGS

SEQ ID NO: 2041 - protein, 27 aa, Artificial Sequence
  GS(G4S)5 linker
GSGGGGSGGGGSGGGGSGGGGSGGGGS

What is claimed is:

1. A variant PD-L2 polypeptide, comprising an IgV domain or both an IgV domain and an IgC domain, wherein the variant PD-L2 polypeptide comprises one or more amino acid substitutions in an unmodified PD-L2, with reference to numbering of SEQ ID NO:31;
wherein the one or more amino acid substitutions are selected from the group consisting of H15Q, H15Q/K65R, H15Q/Q72H/V89D, H15Q/S67L/R76G, H15Q/T47A/Q82R, H15Q/Q82R/V89D, H15Q/S67L/I86T, I13V/H15Q/S67L/I86T, I13V/H15Q/E44D/V89D, H15Q/T47A/Q72H/R76G/I86T, H15Q/T47A/Q72H/R76G, I13V/H15Q/T47A/Q72H/R76G, H15Q/S39I/S67L/V89D, H15Q/N32D/S67L/V89D, H15Q/S67L/Q72H/R76G/V89D, I13V/H15Q/S39I/E44D/S67L, H15Q/V89D, H15Q/T47A, I13V/H15Q/Q82R, I13V/H15Q/V89D, I13V/H15Q/Q82R/V89D, H15Q/V31M/S67L/Q82R/V89D, I13V/H15Q/T47A/Q82R, I13V/H15Q/V31A/N45S/Q82R/V89D, H15Q/T47A/H69L/Q82R/V89D, I13V/H15Q/T47A/H69L/R76G/V89D, I12V/I13V/H15Q/T47A/Q82R/V89D, I13V/H15Q/R76G/D77N/Q82R/V89D, I13V/H15Q/T47A/R76G/V89D, I13V/H15Q/T47A/Q82R/V89D, I13V/H15Q/I36V/T47A/S67L/V89D, H15Q/T47A/K65R/S67L/Q82R/V89D, H15Q/L33P/T47A/S67L/P71S/V89D, I13V/H15Q/Q72H/R76G/I86T, H15Q/T47A/S67L/Q82R/V89D, F2L/H15Q/D46E/T47A/Q72H/R76G/Q82R/V89D, I13V/H15Q/L33F/T47A/Q82R/V89D, H15Q/N24S/T47A/Q72H/R76G/V89D, I13V/H15Q/E44V/T47A/Q82R/V89D, H15Q/N18D/T47A/Q72H/V73A/R76G/I86T/V89D, I13V/H15Q/T37A/E44D/S48C/S67L/Q82R/V89D, H150/L33H/S67L/R76G/Q82R/V89D, I13V/H15Q/T47A/Q72H/R76G/I86T, H15Q/S39I/E44D/Q72H/V75G/R76G/Q82R/V89D, H15Q/T47A/S67L/R76G/Q82R/V89D, and I13V/H15Q/T47A/S67L/Q72H/R76G/Q82R/V89D;

wherein the unmodified PD-L2 comprises the sequence of amino acids set forth in SEQ ID NO:31, or a portion thereof comprising an IgV domain;

wherein the variant PD-L2 polypeptide comprises a sequence of amino acids that exhibits at least 90% sequence identity to SEQ ID NO:31 or the portion of SEQ ID NO:31 comprising the IgV domain; and wherein the variant PD-L2 polypeptide specifically binds to the ectodomain of PD-1 with increased affinity compared to the binding of the unmodified PD-L2 to the ectodomain of PD-1.

2. The variant PD-L2 polypeptide of claim 1 that is a soluble protein.

3. An immunomodulatory protein comprising the variant PD-L2 polypeptide of claim 1, wherein the variant PD-L2 polypeptide is linked to a multimerization domain.

4. The immunomodulatory protein of claim 3, wherein the multimerization domain is an Fc domain or a variant Fc domain with reduced effector function.

5. The variant PD-L2 polypeptide of claim 1, wherein the variant PD-L2 polypeptide comprises a transmembrane domain.

6. The variant PD-L2 polypeptide of claim 5, further comprising a cytoplasmic signaling domain.

7. A pharmaceutical composition, comprising the variant PD-L2 polypeptide of claim 1.

8. An article of manufacture or kit comprising the pharmaceutical composition of claim 7.

9. A pharmaceutical composition, comprising the immunomodulatory protein of claim 4.

* * * * *